US011926667B2

(12) United States Patent
Ganesan et al.

(10) Patent No.: US 11,926,667 B2
(45) Date of Patent: Mar. 12, 2024

(54) BIOENGINEERED T CELL MEDIATED IMMUNITY, MATERIALS AND OTHER METHODS FOR MODULATING CLUSTER OF DIFFERENTIATION IV AND/OR VIII

(71) Applicant: JANSSEN BIOTECH, INC., Horsham, PA (US)

(72) Inventors: Rajkumar Ganesan, Blue Bell, PA (US); Sanjaya Singh, Blue Bell, PA (US); Iqbal S. Grewal, Newtown, PA (US); Michael Riis Hansen, Broomall, PA (US)

(73) Assignee: Janssen Biotech, Inc., Horsham, PA (US)

( * ) Notice: Subject to any disclaimer, the term of this patent is extended or adjusted under 35 U.S.C. 154(b) by 9 days.

(21) Appl. No.: 17/499,597

(22) Filed: Oct. 12, 2021

(65) Prior Publication Data
US 2022/0112288 A1    Apr. 14, 2022

Related U.S. Application Data

(60) Provisional application No. 63/091,078, filed on Oct. 13, 2020.

(51) Int. Cl.
*C07K 16/28* (2006.01)
*C07K 16/46* (2006.01)

(52) U.S. Cl.
CPC ...... *C07K 16/2812* (2013.01); *C07K 16/2815* (2013.01); *C07K 16/468* (2013.01); *C07K 2317/34* (2013.01); *C07K 2317/565* (2013.01)

(58) Field of Classification Search
CPC ............ C07K 16/2812; C07K 16/2815; C07K 16/468; C07K 2317/31
USPC ...................................................... 424/133.1
See application file for complete search history.

(56) References Cited

U.S. PATENT DOCUMENTS

| | | |
|---|---|---|
| 5,225,539 A | 7/1993 | Winter |
| 5,635,483 A | 6/1997 | Pettit et al. |
| 5,677,425 A | 10/1997 | Bodmer et al. |
| 5,734,023 A | 3/1998 | Nag et al. |
| 5,780,588 A | 7/1998 | Pettit et al. |
| 5,820,866 A | 10/1998 | Kappler et al. |
| 5,976,551 A | 11/1999 | Mottez et al. |
| 6,150,584 A | 11/2000 | Kucherlapati et al. |
| 6,270,772 B1 | 8/2001 | Burrows et al. |
| 6,737,056 B1 | 5/2004 | Presta |
| 6,818,749 B1 | 11/2004 | Kashmiri et al. |
| 7,074,905 B2 | 7/2006 | Rhode et al. |
| 7,141,656 B2 | 11/2006 | Rhode et al. |
| 7,709,226 B2 | 5/2010 | Foote |
| 8,748,356 B2 | 6/2014 | Raghunathan |
| 9,150,663 B2 | 10/2015 | Labrijn et al. |
| 9,156,905 B2 | 10/2015 | Muyldermans et al. |
| 10,155,031 B2 | 12/2018 | Sahin et al. |
| 2007/0196363 A1 | 8/2007 | Arathoon et al. |
| 2007/0287170 A1 | 12/2007 | Davis et al. |
| 2009/0182127 A1 | 7/2009 | Kjaergaard et al. |
| 2009/0258420 A1 | 10/2009 | van Vlijmen et al. |
| 2010/0015133 A1 | 1/2010 | Igawa et al. |
| 2010/0261620 A1 | 10/2010 | Almagro et al. |
| 2010/0286374 A1 | 11/2010 | Kannan et al. |
| 2011/0123532 A1 | 5/2011 | Gurney et al. |
| 2012/0149876 A1 | 6/2012 | von Kreudenstein et al. |
| 2013/0195849 A1 | 8/2013 | von Kreudenstein et al. |
| 2014/0112914 A1 | 4/2014 | Nezu et al. |
| 2014/0273092 A1 | 9/2014 | Flikweert et al. |
| 2014/0303356 A1 | 10/2014 | Gramer et al. |
| 2014/0356381 A1 | 12/2014 | Moore et al. |
| 2016/0355600 A1 | 12/2016 | Moore et al. |
| 2017/0145116 A1 | 5/2017 | Regula et al. |
| 2017/0198045 A1 | 7/2017 | Johnson et al. |
| 2018/0118849 A1 | 5/2018 | Klein et al. |
| 2018/0153975 A1 | 6/2018 | Fritsch et al. |
| 2018/0155423 A1 | 6/2018 | Koenig et al. |
| 2018/0243341 A1 | 8/2018 | June et al. |
| 2019/0030147 A1 | 1/2019 | Artomov et al. |
| 2019/0071500 A1 | 3/2019 | Kley et al. |
| 2019/0144534 A1 | 5/2019 | Barrett et al. |
| 2019/0298850 A1 | 10/2019 | Brenner et al. |

(Continued)

FOREIGN PATENT DOCUMENTS

| | | |
|---|---|---|
| EP | 1176195 A1 | 1/2002 |
| EP | 1176195 B1 | 5/2013 |

(Continued)

OTHER PUBLICATIONS

Al-Lazikani et al., 1997, "Standard conformations for the canonical structures of immunoglobulins," J. Mol. Biol., 273(4):927-948.
Altschul et al., 1990, "Basic local alignment search tool, " J. Mol. Biol., 215(3):403-410.
Altschul et al., 1997, "Gapped BLAST and PSI-BLAST: a new generation of protein database search programs," Nucleic Acids Res., 25(17):3389-3402.
Brinkmann et al., 2017, "The making of bispecific antibodies," Mabs, 9(2):182-212.
Cai et al., 2011, "C-terminal lysine processing of human immunoglobulin G2 heavy chain in vivo," Biotechnol. Bioeng., 108(2):404-412.
Chen et al., 2013, "Fusion protein linkers: property, design and functionality," Adv. Drug Deliv. Rev., 65(10):1357-1369 (Epub 2012).

(Continued)

*Primary Examiner* — Lynn A Bristol
(74) *Attorney, Agent, or Firm* — Riverside Law LLP

(57) ABSTRACT

Provided herein, in certain aspects, are antibodies that bind to CD8, as well as recombinant cells containing the vectors, and compositions comprising the antibodies. Also provided herein, in certain aspects, are antibodies that bind to CD4, as well as recombinant cells containing the vectors, and compositions comprising the antibodies. Also provided herein, in certain aspects, are multispecific antibodies that bind to CD4 and CD8, as well as recombinant cells containing the vectors, and compositions comprising the antibodies. Methods of making the antibodies are also provided.

21 Claims, No Drawings

Specification includes a Sequence Listing.

(56) References Cited

U.S. PATENT DOCUMENTS

| | | |
|---|---|---|
| 2019/0330366 A1 | 10/2019 | Eckelman et al. |
| 2019/0352416 A1 | 11/2019 | Moore et al. |
| 2019/0359711 A1 | 11/2019 | Cooper et al. |
| 2020/0308299 A1 | 10/2020 | Naka et al. |
| 2021/0214440 A1 | 7/2021 | Ganesan et al. |
| 2022/0112288 A1* | 4/2022 | Ganesan ............ C07K 16/2812 |

FOREIGN PATENT DOCUMENTS

| | | |
|---|---|---|
| WO | WO 1990004036 A1 | 4/1990 |
| WO | WO 1990007861 A1 | 7/1990 |
| WO | WO 1992022653 A1 | 12/1992 |
| WO | WO 1996027011 A1 | 9/1996 |
| WO | WO 1998025971 A1 | 6/1998 |
| WO | WO 1999015549 A2 | 4/1999 |
| WO | WO 1999015549 A3 | 4/1999 |
| WO | WO 1999045962 A1 | 9/1999 |
| WO | WO 1999054342 A1 | 10/1999 |
| WO | WO 2002043478 A2 | 6/2002 |
| WO | WO 2002043478 A3 | 6/2002 |
| WO | WO 2002066630 A1 | 8/2002 |
| WO | WO 2002088172 A2 | 11/2002 |
| WO | WO 2002088172 A3 | 11/2002 |
| WO | WO 2003035835 A2 | 5/2003 |
| WO | WO 2003035835 A3 | 5/2003 |
| WO | WO 2005003169 A2 | 1/2005 |
| WO | WO 2005003169 A3 | 1/2005 |
| WO | WO 2005003170 A2 | 1/2005 |
| WO | WO 2005003170 A3 | 1/2005 |
| WO | WO 2005003171 A2 | 1/2005 |
| WO | WO 2005003171 A3 | 1/2005 |
| WO | WO 2006028936 A2 | 3/2006 |
| WO | WO 2006028936 A3 | 3/2006 |
| WO | WO 2007147901 A1 | 12/2007 |
| WO | WO 2009080251 A1 | 7/2009 |
| WO | WO 2009085462 A1 | 7/2009 |
| WO | WO 2010091122 A1 | 8/2010 |
| WO | WO 2011131746 A2 | 10/2011 |
| WO | WO 2011131746 A3 | 10/2011 |
| WO | WO 2011143545 A1 | 11/2011 |
| WO | WO 2013096291 A2 | 6/2013 |
| WO | WO 2013096291 A3 | 6/2013 |
| WO | WO 2013157954 A1 | 10/2013 |
| WO | WO 2014082179 A1 | 6/2014 |
| WO | WO 2014145806 A2 | 9/2014 |
| WO | WO 2014145806 A3 | 9/2014 |
| WO | WO 2014150973 A1 | 9/2014 |
| WO | WO 2015184203 A1 | 12/2015 |
| WO | WO 2017124002 A1 | 7/2017 |
| WO | WO 2017173321 A1 | 10/2017 |
| WO | WO 2019033043 A2 | 2/2019 |
| WO | WO 2019033043 A3 | 2/2019 |
| WO | WO 2019195535 A1 | 10/2019 |
| WO | WO 2021127088 A1 | 6/2021 |
| WO | WO 2022081516 A1 | 4/2022 |

OTHER PUBLICATIONS

Chothia et al., 1987, "Canonical structures for the hypervariable regions of immunoglobulins," J. Mol. Biol., 196(4):901-917.
Edwards et al., 2003, "The remarkable flexibility of the human antibody repertoire; isolation of over one thousand different antibodies to a single protein, BLyS," J. Mol. Biol., 334(1):103-118.
Ferrara et al., 2006, "Modulation of therapeutic antibody effector functions by glycosylation engineering: influence of Golgi enzyme localization domain and co-expression of heterologous betal, 4-N-acetylglucosaminyltransferase III and Golgi alpha-mannosidase II," Biotechnol. Bioeng., 93(5):851-861.
Ferrara et al., 2006, "The carbohydrate at FcgammaRIIIa Asn-162. An element required for high affinity binding to non-fucosylated IgG glycoforms," J. Biol. Chem., 281(8):5032-5036 (Epub 2005).
GenBank Accession No. AAH25715.1, "CD8a molecule [*Homo sapiens*]," Jul. 15, 2006 (3 pages).
GenBank Accession No. AAI00912.1, "CD8b molecule [*Homo sapiens*]," Oct. 4, 2006 (3 pages).
GenBank Accession No. NP_000607.1, "T-cell surface glycoprotein CD4 isoform 1 precursor [*Homo sapiens*], "Jan. 29, 2023 (6 pages).
Golay et al., 2016, "Design and Validation of a Novel Generic Platform for the Production of Tetravalent IgG1-like Bispecific Antibodies," J. Immunol., 196(7):3199-3211.
Henikoff et al., 1992, "Amino acid substitution matrices from protein blocks," Proc. Natl. Acad. Sci. USA, 89(22):10915-10919.
Honegger et al., 2001, "Yet another numbering scheme for immunoglobulin variable domains: an automatic modeling and analysis tool," J. Mol. Biol., 309(3):657-670.
International Search Authority, International Search Report and Written Opinion for International Patent Application No. PCT/US2020/065474 (Pub No. WO 2021127088) dated Mar. 26, 2021 (11 pages).
International Search Authority, International Search Report and Written Opinion for International Patent Application No. PCT/US2021/054487 (Pub No. WO 2022081516) dated Mar. 8, 2022 (12 pages).
Jacobs et al., 2010, "Cross-interaction chromatography: a rapid method to identify highly soluble monoclonal antibody candidates," Pharm. Res., 27(1):65-71 (Epub 2009).
Kabat et al., 1977, "Unusual distributions of amino acids in complementarity-determining (hypervariable) segments of heavy and light chains of immunoglobulins and their possible roles in specificity of antibody-combining sites," J. Biol. Chem., 252(19):6609-6616.
Kabat, 1978, "The structural basis of antibody complementarity," Adv. Protein. Chem., 32:1-75.
Karlin et al., 1993, "Applications and statistics for multiple high-scoring segments in molecular sequences," Proc. Natl. Acad. Sci. USA, 90(12):5873-5877.
Klein et al., 2014, "Design and characterization of structured protein linkers with differing flexibilities," Protein Eng. Des. Sel., 27(10):325-330.
Klein et al., 2016, "The use of CrossMAb technology for the generation of bi- and multispecific antibodies," Mabs, 8(6):1010-1020.
Knappik et al., 2000, "Fully synthetic human combinatorial antibody libraries (HuCAL) based on modular consensus frameworks and CDRs randomized with trinucleotides," J. Mol. Biol., 296(1):57-86.
Konno et al., 2012, "Fucose content of monoclonal antibodies can be controlled by culture medium osmolality for high antibody-dependent cellular cytotoxicity," Cytotechnology, 64(3):249-265 (Epub 2011).
Lefranc et al., 2003, "IMGT unique numbering for immunoglobulin and T cell receptor variable domains and Ig superfamily V-like domains," Dev. Comp. Immunol., 27(1):55-77.
Liu et al., 2017, "Fc Engineering for Developing Therapeutic Bispecific Antibodies and Novel Scaffolds," Front Immunol., 8:38 (15 pages).
Lloyd et al., 2009, "Modelling the human immune response: performance of a 1011 human antibody repertoire against a broad panel of therapeutically relevant antigens," Protein Eng. Des. Sel., 22(3):159-168 (Epub 2008).
Martin et al., 1996, "Structural families in loops of homologous proteins: automatic classification, modelling and application to antibodies," J. Mol. Biol., 263(5):800-815.
Mintz et al., 2013, "Protein scaffolds: The next generation of protein therapeutics?" BioProcess International, 11(2):40-48.
Morea et al., 2000, "Antibody modeling: implications for engineering and design," Methods, 20(3):267-279.
Mori et al., 2004, "Engineering Chinese hamster ovary cells to maximize effector function of produced antibodies using FUT8 siRNA," Biotechnol. Bioeng., 88(7):901-908.
Muyldermans, 2001, "Single domain camel antibodies: current status," J. Biotechnol., 74(4):277-302.
Needleman et al., 1970, "A general method applicable to the search for similarities in the amino acid sequence of two proteins," J. Mol. Biol., 48(3):443-453.

(56) References Cited

OTHER PUBLICATIONS

Olivier et al., 2010, "EB66 cell line, a duck embryonic stem cell-derived substrate for the industrial production of therapeutic monoclonal antibodies with enhanced ADCC activity," Mabs, 2(4):405-415.
Padlan, 1991, "A possible procedure for reducing the immunogenicity of antibody variable domains while preserving their ligand-binding properties," Mol. Immunol., 28(4-5):489-498.
Pearson et al., 1988, "Improved tools for biological sequence comparison," Proc. Natl. Acad. Sci. USA, 85(8):2444-2448.
Shi et al., 2010, "De novo selection of high-affinity antibodies from synthetic fab libraries displayed on phage as pIX fusion proteins," J. Mol. Biol., 397(2):385-396.
Shields et al., 2002, "Lack of fucose on human IgG1 N-linked oligosaccharide improves binding to human Fcgamma RIII and antibody-dependent cellular toxicity," J. Biol. Chem., 277(30):26733-26740.
Shinkawa et al., 2003, "The absence of fucose but not the presence of galactose or bisecting N-acetylglucosamine of human IgG1 complex-type oligosaccharides shows the critical role of enhancing antibody-dependent cellular cytotoxicity," J. Biol. Chem., 278(5):3466-3473 (Epub 2002).
Smith et al., 1981, "Comparison of biosequences," Adv. Appl. Math., 2(4):482-489.
Umana et al., 1999, "Engineered glycoforms of an antineuroblastoma IgG1 with optimized antibody-dependent cellular cytotoxic activity," Nat. Biotechnol., 17(2):176-180.
Woyke et al., 2001, "In vitro activities and postantifungal effects of the potent dolastatin 10 derivative auristatin PHE," Antimicrob. Agents Chemother., 45(12):3580-3584.
Wu et al., 1970, "An analysis of the sequences of the variable regions of Bence Jones proteins and myeloma light chains and their implications for antibody complementarity," J. Exp. Med., 132(2):211-250.
Zhao et al., 2011, "Stabilization of the single-chain fragment variable by an interdomain disulfide bond and its effect on antibody affinity," Int. J. Mol. Sci., 12(1):1-11 (Epub 2010).
Zhou et al., 2008, "Development of a simple and rapid method for producing non-fucosylated oligomannose containing antibodies with increased effector function," Biotechnol. Bioeng., 99(3):652-665.

* cited by examiner

US 11,926,667 B2

BIOENGINEERED T CELL MEDIATED IMMUNITY, MATERIALS AND OTHER METHODS FOR MODULATING CLUSTER OF DIFFERENTIATION IV AND/OR VIII

CROSS-REFERENCE TO RELATED APPLICATIONS

This application claims the benefit of U.S. Ser. No. 63/091,078 filed Oct. 13, 2020, the disclosure of which is incorporated by reference herein in its entirety.

FIELD

Provided herein, in certain aspects, are antibodies that bind to CD4, as well as recombinant cells containing the vectors, and compositions comprising the antibodies. Also provided herein, in certain aspects, are antibodies that bind to CD8, as well as recombinant cells containing the vectors, and compositions comprising the antibodies. Also provided herein, in certain aspects, are multispecific antibodies that bind to CD4 and CD8, as well as recombinant cells containing the vectors, and compositions comprising the antibodies. Methods of making and using the antibodies are also provided.

REFERENCE TO SEQUENCE LISTING SUBMITTED ELECTRONICALLY

This application contains a sequence listing, which is submitted electronically via EFS-Web as an ASCII formatted sequence listing with a file name of "14620-269-999_SL.txt" and a creation date of Oct. 7, 2021 and having a size of 1,812,825 bytes. The sequence listing submitted via EFS-Web is part of the specification and is herein incorporated by reference in its entirety.

SUMMARY

In one aspect, provided herein is an antibody that binds CD8. In one embodiment, the CD8 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:31; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:32. In one embodiment, the CD8 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:65; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:66. In one embodiment, the CD8 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:99; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:100. In one embodiment, the CD8 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:133; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:134. In one embodiment, the CD8 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:167; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:168. In one embodiment, the CD8 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:201; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:202. In one embodiment, the CD8 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:235; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:236. In one embodiment, the CD8 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:269; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:270. In one embodiment, the CD8 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:303; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:304. In one embodiment, the CD8 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:337; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:338. In one embodiment, the CD8 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:371; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:372. In one embodiment, the CD8 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:405; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:406. In one embodiment, the CD8 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:439; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:440. In one embodiment, the CD8 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:473; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:474. In one embodiment, the CD8 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:507; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:508. In one embodiment, the CD8 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:541; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:542. In one embodiment, the CD8 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:575; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:576. In one embodiment, the CD8 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:609; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:610. In one embodiment, the CD8 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:643; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:644. In one embodiment, the CD8 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:677; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:678. In one embodiment, the CD8 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:711; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:712. In one embodiment, the CD8 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:745; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:746. In one embodiment, the CD8 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:779; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:780. In one embodiment, the CD8 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:813; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:814. In one embodiment, the CD8 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:847; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:848. In one embodiment, the CD8 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:881; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:882. In one embodiment, the CD8 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:915; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:916. In one embodiment, the CD8 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:949; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:950. In one embodiment, the CD8 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:983; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:984. In one embodiment, the CD8 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1017; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1018. In one embodiment, the CD8 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1051; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1052. In one embodiment, the CD8 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1085; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1086. In one embodiment, the CD8 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1119; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1120. In one embodiment, the CD8 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1153; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1154. In one embodiment, the CD8 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1187; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1188. In one embodiment, the CD8 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1221; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1222. In one embodiment, the CD8 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1255; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1256. In one embodiment, the CD8 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1289; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1290. In one embodiment, the CD8 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1323; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1324. In one embodiment, the CD8 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1357; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1358. In one embodiment, the CD8 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1391; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1392. In one embodiment, the CD8 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1425; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1426. In one embodiment, the CD8 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1459; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1460. In one embodiment, the CD8 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1493; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1494. In one embodiment, the CD8 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1527; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1528. In one embodiment, the CD8 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1561; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1562. In one embodiment, the CD8 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1595; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1596. In one embodiment, the CD8 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1629; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1630. In one embodiment, the CD8 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1663; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1664. In one embodiment, the CD8 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1697; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1698. In one embodiment, the CD8 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1731; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1732. In one embodiment, the CD8 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1765; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1766.

In one embodiment, the CD8 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1799; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1800. In one embodiment, the CD8 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1833; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1834. In one embodiment, the CD8 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1867; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1868. In one embodiment, the CD8 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1901; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1902. In one embodiment, the CD8 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1935; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1936. In one embodiment, the CD8 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1969; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1970. In one embodiment, the CD8 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2003; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2004. In another aspect, provided herein is an antibody that binds CD8. In one embodiment, the CD8 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2037; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2038. In one embodiment, the CD8 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2071; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2072. In one embodiment, the CD8 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2105; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2106. In one embodiment, the CD8 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2139; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2140. In one embodiment, the CD8 antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2173; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2174.

In some embodiments, the VH CDR1, VH CDR2, VH CDR3, VL CDR1, VL CDR2, and VL CDR3 amino acid sequences of the CD8 antibody are according to the Kabat numbering system. In some embodiments, the VH CDR1, VH CDR2, VH CDR3, VL CDR1, VL CDR2, and VL CDR3 amino acid sequences of the CD8 antibody are according to the Chothia numbering system. In some embodiments, the VH CDR1, VH CDR2, VH CDR3, VL CDR1, VL CDR2, and VL CDR3 amino acid sequences of the CD8 antibody are according to the AbM numbering system. In some embodiments, the VH CDR1, VH CDR2, VH CDR3, VL CDR1, VL CDR2, and VL CDR3 amino acid sequences of the CD8 antibody are according to the Contact numbering system. In some embodiments, the VH CDR1, VH CDR2, VH CDR3, VL CDR1, VL CDR2, and VL CDR3 amino acid sequences of the CD8 antibody are according to the IMGT numbering system.

In some embodiments, the antibody binds a CD8 antigen. In some embodiments, antibody binds a CD8 epitope. In some embodiments, the antibody specifically binds to CD8. In some embodiments, the VH CDR1, VH CDR2, VH CDR3, VL CDR1, VL CDR2 and VL CDR3 form a binding site for an antigen of the CD8. In some embodiments, the VH CDR1, VH CDR2, VH CDR3, VL CDR1, VL CDR2 and VL CDR3 form a binding site for an epitope of the CD8. In some embodiments, the CD8 is present on the surface of a T cell.

In some embodiments, the antibody binds to CD8a. In some embodiments, the antibody binds a CD8a antigen. In some embodiments, antibody binds a CD8a epitope. In some embodiments, the antibody specifically binds to CD8a. In some embodiments, the VH CDR1, VH CDR2, VH CDR3, VL CDR1, VL CDR2 and VL CDR3 form a binding site for an antigen of the CD8a. In some embodiments, the VH CDR1, VH CDR2, VH CDR3, VL CDR1, VL CDR2 and VL CDR3 form a binding site for an epitope of the CD8a. In some embodiments, the CD8a is present on the surface of a T cell.

In some embodiments, the antibody binds to CD8β. In some embodiments, the antibody binds a CD8β antigen. In some embodiments, antibody binds a CD8β epitope. In some embodiments, the antibody specifically binds to CD8β. In some embodiments, the VH CDR1, VH CDR2, VH CDR3, VL CDR1, VL CDR2 and VL CDR3 form a binding site for an antigen of the CD8β. In some embodiments, the VH CDR1, VH CDR2, VH CDR3, VL CDR1, VL CDR2 and VL CDR3 form a binding site for an epitope of the CD8β. In some embodiments, the CD8β is present on the surface of a T cell.

In some embodiments, the antibody binds at the interface of CD8α and CD8p. In some embodiments, the antibody binds an antigen at the interface of CD8α and CD8β. In some embodiments, antibody binds an epitope at the interface of CD8α and CD8β. In some embodiments, the antibody specifically binds at the interface of CD8α and CD8β. In some embodiments, the VH CDR1, VH CDR2, VH CDR3, VL CDR1, VL CDR2 and VL CDR3 form a binding site for an antigen at the interface of CD8α and CD8β. In some embodiments, the VH CDR1, VH CDR2, VH CDR3, VL CDR1, VL CDR2 and VL CDR3 form a binding site for an epitope at the interface of CD8α and CD8β. In some embodiments, the interface of CD8α and CD8β is present on the surface of a T cell.

In some embodiments, the CD8 antibody is a humanized antibody. In some embodiments, the antibody is an IgG antibody. In some embodiments, the CD8 antibody is an IgG1 antibody. In some embodiments, the CD8 antibody is an IgG2 antibody. In some embodiments, the CD8 antibody is an IgG3 antibody. In some embodiments, the CD8 antibody is an IgG4 antibody. In some embodiments, the CD8 antibody comprises a kappa light chain. In some embodiments, the CD8 the antibody comprises a lambda light chain. In some embodiments, the CD8 antibody is a monoclonal antibody. In some embodiments, the CD8 antibody is multivalent. In some embodiments, the CD8 antibody is capable of binding at least three antigens. In some embodiments, the CD8 antibody is capable of binding at least four antigens. In some embodiments, the CD8 antibody is capable of binding at least five antigens. In some embodiments, the CD8 antibody is a multispecific antibody. In some embodiments, the CD8 antibody is a bispecific antibody. In some embodiments, the CD8 antibody is a trispecific antibody. In some embodiments, the CD8 antibody is a quadraspecific antibody.

In some embodiments, the multispecific CD8 antibody comprises: (i) a first binding domain that binds CD8, and a second binding domain that binds to a second target; (ii) a first binding domain that binds CD8, a second binding domain that binds to a second target, and a third binding domain that binds to a third target; or (iii) a first binding domain that binds CD8, and a second binding domain that binds to a second target, a third binding domain that binds to a third target, and a fourth binding domain that binds to a fourth target. In some embodiments, the second target is CD4. In some embodiments, the second target is a T cell receptor (TCR) complex, CD3, CD3ε, CD3γ, CD3δ, CD3ζ, a TCRα chain, a TCRβ chain, a TCRγ chain, or a TCRδ chain. In some embodiments, the second target is a T cell costimulatory molecule, CD28, CTLA4, ICOS, 4-1BB, GITR, CD27, OX40, CD40L, HVEM, Galectin-9, TIM-1, LFA1, CD2 or PD1. In some embodiments, the second target is CD4; and the third target is a TCR complex, CD3, CD3ε, CD3γ, CD3δ, CD3ζ, a TCRα chain, a TCRβ chain, a TCRγ chain, a TCRδ chain. In some embodiments, the second target is CD4; and the third target is a T cell costimulatory molecule, CD28, CTLA4, ICOS, 4-1BB, GITR, CD27, OX40, CD40L, HVEM, Galectin-9, TIM-1, LFA1, CD2, or PD1. In some embodiments, the second target is a TCR complex, CD3, CD3ε, CD3γ, CD3δ, CD3ζ, a TCRα chain, a TCRβ chain, a TCRγ chain, or a TCRδ chain; and the third target is a T cell costimulatory molecule, CD28, CTLA4, ICOS, 4-1BB, GITR, CD27, OX40, CD40L, HVEM, Galectin-9, TIM-1, LFA1, CD2, or PD1. In some embodiments, the second target is CD4; wherein the third target is a TCR complex, CD3, CD3ε, CD3γ, CD3δ, CD3ζ, a TCRα chain, a TCRβ chain, a TCRγ chain, or a TCRδ chain; and wherein the fourth target is a T cell costimulatory molecule, CD28, CTLA4, ICOS, 4-1BB, GITR, CD27, OX40, CD40L, HVEM, Galectin-9, TIM-1, LFA1, CD2, or PD1.

Also provided herein is a multispecific CD8 antibody, wherein the multispecific CD8 antibody comprises: a first binding domain that binds CD8, and a second binding domain that binds to a second target, a third binding domain that binds to a third target, and a fourth binding domain that binds to a fourth target. In some embodiments, the second target is CD4, the third target is a TCR complex, and the fourth target is a T cell costimulatory molecule. In some embodiments, the third target is CD3. In some embodiments, the third target is CD3ε. In some embodiments, the third target is CD3γ. In some embodiments, the third target is CD3δ. In some embodiments, the third target is CD3ζ. In some embodiments, the third target is a TCRα chain. In some embodiments, the third target is a TCRβ chain. In some embodiments, the third target is a TCRγ chain. In some embodiments, the third target is a TCRδ chain. In some embodiments, the fourth target is CD28. In some embodiments, the fourth target is CTLA4. In some embodiments, the fourth target is ICOS. In some embodiments, the fourth target is 4-1BB. In some embodiments, the fourth target is GITR. In some embodiments, the fourth target is CD27. In some embodiments, the fourth target is OX40. In some embodiments, the fourth target is CD40L. In some embodiments, the fourth target is HVEM. In some embodiments, the fourth target is Galectin-9. In some embodiments, the fourth target is TIM-1. In some embodiments, the fourth target is LFA1. In some embodiments, the fourth target is CD2. In some embodiments, the fourth target is PD1.

Also provided herein is a multispecific CD8 antibody, wherein the multispecific CD8 antibody comprises: a first binding domain that binds CD8, and a second binding domain that binds to CD4.

In a specific embodiments, provided is a multispecific antibody, wherein the multispecific antibody comprises: a first binding domain that binds to CD8 and a second binding domain that binds to CD4. In a certain embodiments, the first binding domain that binds to CD8 is a CD8 antibody provided herein. In other embodiments, the second binding domain that binds to CD4 is a CD4 antibody provided herein. In specific embodiments, the first binding domain that binds to CD8 is a CD8 antibody provided herein, and the second binding domain that binds to CD4 is a CD4 antibody provided herein. In certain embodiments, the multispecific antibody further binds a third target as provided herein. In other embodiments, the multispecific antibody further binds a third target as provided herein and a fourth target as provided herein.

Also provided herein is a multispecific CD8 antibody, wherein the multispecific CD8 antibody comprises a first binding domain that binds CD8, a second binding domain that binds to a second target, and a third binding domain that binds to a third target. In some embodiments, the second target is a TCR complex, and the third target is a T cell costimulatory molecule. In some embodiments, the second target is CD3. In some embodiments, the second target is CD3ε. In some embodiments, the second target is CD3γ. In some embodiments, the second target is CD3δ. In some embodiments, the second target is CD3ζ. In some embodiments, the second target is a TCRα chain. In some embodiments, the second target is a TCRβ chain. In some embodiments, the second target is a TCRγ chain. In some embodiments, the second target is a TCRδ chain. In some embodiments, the third target is CD28. In some embodiments, the third target is CTLA4. In some embodiments, the third target is ICOS. In some embodiments, the third target is 4-1BB. In some embodiments, the third target is GITR. In some embodiments, the third target is CD27. In some embodiments, the third target is OX40. In some embodiments, the third target is CD40L. In some embodiments, the third target is HVEM. In some embodiments, the third target is Galectin-9. In some embodiments, the third target is TIM-1. In some embodiments, the third target is LFA1. In some embodiments, the third target is CD2. In some embodiments, the third target is PD1.

In another aspect, provided is a nucleic acid encoding a CD8 antibody provided herein. Also provided is a vector comprising a nucleic acid encoding a CD8 antibody provided herein. Also provided is a host cell comprising a vector comprising a nucleic acid encoding a CD8 antibody provided herein. Also provided is a kit comprising vector comprising a nucleic acid encoding a CD8 antibody provided herein, and packaging for the same.

In another aspect, provided is a kit comprising a CD8 antibody provided herein, and packaging for the same.

In another aspect, provided is a pharmaceutical composition comprising a CD8 antibody provided herein, and a pharmaceutically acceptable carrier.

In another aspect, provided is a method of producing a pharmaceutical composition comprising a CD8 antibody provided herein, comprising combining the CD8 antibody with a pharmaceutically acceptable carrier to obtain the pharmaceutical composition.

In another aspect, provided is a method of activating a T cell expressing CD8, comprising contacting the T cell with a CD8 antibody provided herein. In certain embodiments, the contacting results in an increase in CD69, CD25, and/or Granzyme B expression, as compared to a control T cell expressing CD8.

In another aspect, provided is a method of enriching, isolating, separating, purifying, sorting, selecting, capturing or detecting a CD8-expressing cell comprising: providing a sample comprising the CD8-expressing cell; contacting the sample with the CD8 antibody provided herein; and enriching, isolating, separating, purifying, sorting, selecting, capturing or detecting the CD8-expressing cell bound to the CD8 antibody. In another aspect, provided is a method of enriching, isolating, separating, purifying, sorting, selecting, capturing or detecting a CD8-expressing cell comprising: contacting a CD8-expressing cell with the CD8 antibody provided herein; and enriching, isolating, separating, purifying, sorting, selecting, capturing or detecting the CD8-expressing cell bound to the CD8 antibody. In another aspect, provided is a method of enriching, isolating, separating, purifying, sorting, selecting, capturing or detecting a CD8-expressing cell comprising: contacting a CD8-expressing cell with the CD8 antibody provided herein; and enriching, isolating, separating, purifying, sorting, selecting, capturing or detecting the CD8-expressing cell based on binding of the CD8-expressing cell to the CD8 antibody. In some embodiments, the CD8-expressing cell is a T cell. In some embodiments, the CD8-expressing cell is a CD8+ cytotoxic T lymphocyte (CTL). In some embodiments, the CD8-expressing cell is provided as a sample comprising a population of cells. In some embodiments, the cells are lymphocytes. In some embodiments, the cells are T cells. In some embodiments, the sample is a blood sample. In some embodiments, the sample is a tissue sample. In some embodiments, the CD8 antibody is a multispecific CD8 antibody provided herein.

In another aspect, provided herein is an antibody that binds CD4. In one embodiment, the CD4 antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:2207; and (ii) a VL comprising a VL CDR1, a VL CDR2, and a VL CDR3 having an amino acid sequence of a VL CDR1, a VL CDR2, and a VL CDR3, respectively, of SEQ ID NO:2208. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:2241; and (ii) a VL comprising a VL CDR1, a VL CDR2, and a VL CDR3 having an amino acid sequence of a VL CDR1, a VL CDR2, and a VL CDR3, respectively, of SEQ ID NO:2242. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:2275; and (ii) a VL comprising a VL CDR1, a VL CDR2, and a VL CDR3 having an amino acid sequence of a VL CDR1, a VL CDR2, and a VL CDR3, respectively, of SEQ ID NO:2276. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:2309; and (ii) a VL comprising a VL CDR1, a VL CDR2, and a VL CDR3 having an amino acid sequence of a VL CDR1, a VL CDR2, and a VL CDR3, respectively, of SEQ ID NO:2310. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:2343; and (ii) a VL comprising a VL CDR1, a VL CDR2, and a VL CDR3 having an amino acid sequence of a VL CDR1, a VL CDR2, and a VL CDR3, respectively, of SEQ ID NO:2344. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:2377; and (ii) a VL comprising a VL CDR1, a VL CDR2, and a VL CDR3 having an amino acid sequence of a VL CDR1, a VL CDR2, and a VL CDR3, respectively, of SEQ ID NO:2378. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:2411; and (ii) a VL comprising a VL CDR1, a VL CDR2, and a VL CDR3 having an amino acid sequence of a VL CDR1, a VL CDR2, and a VL CDR3, respectively, of SEQ ID NO:2412. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:2445; and (ii) a VL comprising a VL CDR1, a VL CDR2, and a VL CDR3 having an amino acid sequence of a VL CDR1, a VL CDR2, and a VL CDR3, respectively, of SEQ ID NO:2446. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:2479; and (ii) a VL comprising a VL CDR1, a VL CDR2, and a VL CDR3 having an amino acid sequence of a VL CDR1, a VL CDR2, and a VL CDR3, respectively, of SEQ ID NO:2480. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:2513; and (ii) a VL comprising a VL CDR1, a VL CDR2, and a VL CDR3 having an amino acid sequence of a VL CDR1, a VL CDR2, and a VL CDR3, respectively, of SEQ ID NO:2514. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:2547; and (ii) a VL comprising a VL CDR1, a VL CDR2, and a VL CDR3 having an amino acid sequence of a VL CDR1, a VL CDR2, and a VL CDR3, respectively, of SEQ ID NO:2548. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:2581; and (ii) a VL comprising a VL CDR1, a VL CDR2, and a VL CDR3 having an amino acid sequence of a VL CDR1, a VL CDR2, and a VL CDR3, respectively, of SEQ ID NO:2582. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:2615; and (ii) a VL comprising a VL CDR1, a VL CDR2, and a VL CDR3 having an amino acid sequence of a VL CDR1, a VL CDR2, and a VL CDR3, respectively, of SEQ ID NO:2616. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:2649; and (ii) a VL comprising a VL CDR1, a VL CDR2, and a VL CDR3 having an amino acid sequence of a VL CDR1, a VL CDR2, and a VL CDR3, respectively, of SEQ ID NO:2650. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:2683; and (ii) a VL comprising a VL CDR1, a VL CDR2, and a VL CDR3 having an amino acid sequence of a VL CDR1, a VL CDR2, and a VL CDR3, respectively, of SEQ ID NO:2684. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:2717; and (ii) a VL comprising a VL CDR1, a VL CDR2, and a VL CDR3 having an amino acid sequence of a VL CDR1, a VL CDR2, and a VL CDR3, respectively, of SEQ ID NO:2718. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:2751; and (ii) a VL comprising a VL CDR1, a VL CDR2, and a VL CDR3 having an amino acid sequence of a VL CDR1, a VL CDR2, and a VL CDR3, respectively, of SEQ ID NO:2752. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:2785; and (ii) a VL comprising a VL CDR1, a VL CDR2, and a VL CDR3 having an amino acid sequence of a VL CDR1, a VL CDR2, and a VL CDR3, respectively, of SEQ ID NO:2786. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:2819; and (ii) a VL comprising a VL CDR1, a VL CDR2, and a VL CDR3 having an amino acid sequence of a VL CDR1, a VL CDR2, and a VL CDR3, respectively, of SEQ ID NO:2820. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:2853; and (ii) a VL comprising a VL CDR1, a VL CDR2, and a VL CDR3 having an amino acid sequence of a VL CDR1, a VL CDR2, and a VL CDR3, respectively, of SEQ ID NO:2854. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:2887; and (ii) a VL comprising a VL CDR1, a VL CDR2, and a VL CDR3 having an amino acid sequence of a VL CDR1, a VL CDR2, and a VL CDR3, respectively, of SEQ ID NO:2888. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:2921; and (ii) a VL comprising a VL CDR1, a VL CDR2, and a VL CDR3 having an amino acid sequence of a VL CDR1, a VL CDR2, and a VL CDR3, respectively, of SEQ ID NO:2922. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:2955; and (ii) a VL comprising a VL CDR1, a VL CDR2, and a VL CDR3 having an amino acid sequence of a VL CDR1, a VL CDR2, and a VL CDR3, respectively, of SEQ ID NO:2956. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:2989; and (ii) a VL comprising a VL CDR1, a VL CDR2, and a VL CDR3 having an amino acid sequence of a VL CDR1, a VL CDR2, and a VL CDR3, respectively, of SEQ ID NO:2990. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:3023; and (ii) a VL comprising a VL CDR1, a VL CDR2, and a VL CDR3 having an amino acid sequence of a VL CDR1, a VL CDR2, and a VL CDR3, respectively, of SEQ ID NO:3024. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:3057; and (ii) a VL comprising a VL CDR1, a VL CDR2, and a VL CDR3 having an amino acid sequence of a VL CDR1, a VL CDR2, and a VL CDR3, respectively, of SEQ ID NO:3058. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:3091; and (ii) a VL comprising a VL CDR1, a VL CDR2, and a VL CDR3 having an amino acid sequence of a VL CDR1, a VL CDR2, and a VL CDR3, respectively, of SEQ ID NO:3092. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:3125; and (ii) a VL comprising a VL CDR1, a VL CDR2, and a VL CDR3 having an amino acid sequence of a VL CDR1, a VL CDR2, and a VL CDR3, respectively, of SEQ ID NO:3126. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:3159; and (ii) a VL comprising a VL CDR1, a VL CDR2, and a VL CDR3 having an amino acid sequence of a VL CDR1, a VL CDR2, and a VL CDR3, respectively, of SEQ ID NO:3160. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:3193; and (ii) a VL comprising a VL CDR1, a VL CDR2, and a VL CDR3 having an amino acid sequence of a VL CDR1, a VL CDR2, and a VL CDR3, respectively, of SEQ ID NO:3194. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:3227; and (ii) a VL comprising a VL CDR1, a VL CDR2, and a VL CDR3 having an amino acid sequence of a VL CDR1, a VL CDR2, and a VL CDR3, respectively, of SEQ ID NO:3228. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:3261; and (ii) a VL comprising a VL CDR1, a VL CDR2, and a VL CDR3 having an amino acid sequence of a VL CDR1, a VL CDR2, and a VL CDR3, respectively, of SEQ ID NO:3262. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:3295; and (ii) a VL comprising a VL CDR1, a VL CDR2, and a VL CDR3 having an amino acid sequence of a VL CDR1, a VL CDR2, and a VL CDR3, respectively, of SEQ ID NO:3296. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:3329; and (ii) a VL comprising a VL CDR1, a VL CDR2, and a VL CDR3 having an amino acid sequence of a VL CDR1, a VL CDR2, and a VL CDR3, respectively, of SEQ ID NO:3330. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:3363; and (ii) a VL comprising a VL CDR1, a VL CDR2, and a VL CDR3 having an amino acid sequence of a VL CDR1, a VL CDR2, and a VL CDR3, respectively, of SEQ ID NO:3364. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:3397; and (ii) a VL comprising a VL CDR1, a VL CDR2, and a VL CDR3 having an amino acid sequence of a VL CDR1, a VL CDR2, and a VL CDR3, respectively, of SEQ ID NO:3398. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:3431; and (ii) a VL comprising a VL CDR1, a VL CDR2, and a VL CDR3 having an amino acid sequence of a VL CDR1, a VL CDR2, and a VL CDR3, respectively, of SEQ ID NO:3432. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:3465; and (ii) a VL comprising a VL CDR1, a VL CDR2, and a VL CDR3 having an amino acid sequence of a VL CDR1, a VL CDR2, and a VL CDR3, respectively, of SEQ ID NO:3466. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:3499; and (ii) a VL comprising a VL CDR1, a VL CDR2, and a VL CDR3 having an amino acid sequence of a VL CDR1, a VL CDR2, and a VL CDR3, respectively, of SEQ ID NO:3500. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:3533; and (ii) a VL comprising a VL CDR1, a VL CDR2, and a VL CDR3 having an amino acid sequence of a VL CDR1, a VL CDR2, and a VL CDR3, respectively, of SEQ ID NO:3534. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:3567; and (ii) a VL comprising a VL CDR1, a VL CDR2, and a VL CDR3 having an amino acid sequence of a VL CDR1, a VL CDR2, and a VL CDR3, respectively, of SEQ ID NO:3568. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:3601; and (ii) a VL comprising a VL CDR1, a VL CDR2, and a VL CDR3 having an amino acid sequence of a VL CDR1, a VL CDR2, and a VL CDR3, respectively, of SEQ ID NO:3602. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:3635; and (ii) a VL comprising a VL CDR1, a VL CDR2, and a VL CDR3 having an amino acid sequence of a VL CDR1, a VL CDR2, and a VL CDR3, respectively, of SEQ ID NO:3636. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:3669; and (ii) a VL comprising a VL CDR1, a VL CDR2, and a VL CDR3 having an amino acid sequence of a VL CDR1, a VL CDR2, and a VL CDR3, respectively, of SEQ ID NO:3670. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:3703; and (ii) a VL comprising a VL CDR1, a VL CDR2, and a VL CDR3 having an amino acid sequence of a VL CDR1, a VL CDR2, and a VL CDR3, respectively, of SEQ ID NO:3704. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:3737; and (ii) a VL comprising a VL CDR1, a VL CDR2, and a VL CDR3 having an amino acid sequence of a VL CDR1, a VL CDR2, and a VL CDR3, respectively, of SEQ ID NO:3738. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:3771; and (ii) a VL comprising a VL CDR1, a VL CDR2, and a VL CDR3 having an amino acid sequence of a VL CDR1, a VL CDR2, and a VL CDR3, respectively, of SEQ ID NO:3772. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:3805; and (ii) a VL comprising a VL CDR1, a VL CDR2, and a VL CDR3 having an amino acid sequence of a VL CDR1, a VL CDR2, and a VL CDR3, respectively, of SEQ ID NO:3806. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:3839; and (ii) a VL comprising a VL CDR1, a VL CDR2, and a VL CDR3 having an amino acid sequence of a VL CDR1, a VL CDR2, and a VL CDR3, respectively, of SEQ ID NO:3840. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:3873; and (ii) a VL comprising a VL CDR1, a VL CDR2, and a VL CDR3 having an amino acid sequence of a VL CDR1, a VL CDR2, and a VL CDR3, respectively, of SEQ ID NO:3874. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:3907; and (ii) a VL comprising a VL CDR1, a VL CDR2, and a VL CDR3 having an amino acid sequence of a VL CDR1, a VL CDR2, and a VL CDR3, respectively, of SEQ ID NO:3908. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:3941; and (ii) a VL comprising a VL CDR1, a VL CDR2, and a VL CDR3 having an amino acid sequence of a VL CDR1, a VL CDR2, and a VL CDR3, respectively, of SEQ ID NO:3942. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:3975; and (ii) a VL comprising a VL CDR1, a VL CDR2, and a VL CDR3 having an amino acid sequence of a VL CDR1, a VL CDR2, and a VL CDR3, respectively, of SEQ ID NO:3976. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:4009; and (ii) a VL comprising a VL CDR1, a VL CDR2, and a VL CDR3 having an amino acid sequence of a VL CDR1, a VL CDR2, and a VL CDR3, respectively, of SEQ ID NO:4010. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:4043; and (ii) a VL comprising a VL CDR1, a VL CDR2, and a VL CDR3 having an amino acid sequence of a VL CDR1, a VL CDR2, and a VL CDR3, respectively, of SEQ ID NO:4044. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:4077; and (ii) a VL comprising a VL CDR1, a VL CDR2, and a VL CDR3 having an amino acid sequence of a VL CDR1, a VL CDR2, and a VL CDR3, respectively, of SEQ ID NO:4078. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:4111; and (ii) a VL comprising a VL CDR1, a VL CDR2, and a VL CDR3 having an amino acid sequence of a VL CDR1, a VL CDR2, and a VL CDR3, respectively, of SEQ ID NO:4112. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:4145; and (ii) a VL comprising a VL CDR1, a VL CDR2, and a VL CDR3 having an amino acid sequence of a VL CDR1, a VL CDR2, and a VL CDR3, respectively, of SEQ ID NO:4146. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:4179; and (ii) a VL comprising a VL CDR1, a VL CDR2, and a VL CDR3 having an amino acid sequence of a VL CDR1, a VL CDR2, and a VL CDR3, respectively, of SEQ ID NO:4180. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:4213; and (ii) a VL comprising a VL CDR1, a VL CDR2, and a VL CDR3 having an amino acid sequence of a VL CDR1, a VL CDR2, and a VL CDR3, respectively, of SEQ ID NO:4214. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:4247; and (ii) a VL comprising a VL CDR1, a VL CDR2, and a VL CDR3 having an amino acid sequence of a VL CDR1, a VL CDR2, and a VL CDR3, respectively, of SEQ ID NO:4248. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:4281; and (ii) a VL comprising a VL CDR1, a VL CDR2, and a VL CDR3 having an amino acid sequence of a VL CDR1, a VL CDR2, and a VL CDR3, respectively, of SEQ ID NO:4282. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:4315; and (ii) a VL comprising a VL CDR1, a VL CDR2, and a VL CDR3 having an amino acid sequence of a VL CDR1, a VL CDR2, and a VL CDR3, respectively, of SEQ ID NO:4316. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:4349; and (ii) a VL comprising a VL CDR1, a VL CDR2, and a VL CDR3 having an amino acid sequence of a VL CDR1, a VL CDR2, and a VL CDR3, respectively, of SEQ ID NO:4350. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:4383; and (ii) a VL comprising a VL CDR1, a VL CDR2, and a VL CDR3 having an amino acid sequence of a VL CDR1, a VL CDR2, and a VL CDR3, respectively, of SEQ ID NO:4384. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:4417; and (ii) a VL comprising a VL CDR1, a VL CDR2, and a VL CDR3 having an amino acid sequence of a VL CDR1, a VL CDR2, and a VL CDR3, respectively, of SEQ ID NO:4418. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:4451; and (ii) a VL comprising a VL CDR1, a VL CDR2, and a VL CDR3 having an amino acid sequence of a VL CDR1, a VL CDR2, and a VL CDR3, respectively, of SEQ ID NO:4452. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:4485; and (ii) a VL comprising a VL CDR1, a VL CDR2, and a VL CDR3 having an amino acid sequence of a VL CDR1, a VL CDR2, and a VL CDR3, respectively, of SEQ ID NO:4486. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:4519; and (ii) a VL comprising a VL CDR1, a VL CDR2, and a VL CDR3 having an amino acid sequence of a VL CDR1, a VL CDR2, and a VL CDR3, respectively, of SEQ ID NO:4520. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:4553; and (ii) a VL comprising a VL CDR1, a VL CDR2, and a VL CDR3 having an amino acid sequence of a VL CDR1, a VL CDR2, and a VL CDR3, respectively, of SEQ ID NO:4554. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:4587; and (ii) a VL comprising a VL CDR1, a VL CDR2, and a VL CDR3 having an amino acid sequence of a VL CDR1, a VL CDR2, and a VL CDR3, respectively, of SEQ ID NO:4588. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:4621; and (ii) a VL comprising a VL CDR1, a VL CDR2, and a VL CDR3 having an amino acid sequence of a VL CDR1, a VL CDR2, and a VL CDR3, respectively, of SEQ ID NO:4622. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:4655; and (ii) a VL comprising a VL CDR1, a VL CDR2, and a VL CDR3 having an amino acid sequence of a VL CDR1, a VL CDR2, and a VL CDR3, respectively, of SEQ ID NO:4656. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:4689; and (ii) a VL comprising a VL CDR1, a VL CDR2, and a VL CDR3 having an amino acid sequence of a VL CDR1, a VL CDR2, and a VL CDR3, respectively, of SEQ ID NO:4690. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:4723; and (ii) a VL comprising a VL CDR1, a VL CDR2, and a VL CDR3 having an amino acid sequence of a VL CDR1, a VL CDR2, and a VL CDR3, respectively, of SEQ ID NO:4724. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:4757; and (ii) a VL comprising a VL CDR1, a VL CDR2, and a VL CDR3 having an amino acid sequence of a VL CDR1, a VL CDR2, and a VL CDR3, respectively, of SEQ ID NO:4758. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:4791; and (ii) a VL comprising a VL CDR1, a VL CDR2, and a VL CDR3 having an amino acid sequence of a VL CDR1, a VL CDR2, and a VL CDR3, respectively, of SEQ ID NO:4792. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:4825; and (ii) a VL comprising a VL CDR1, a VL CDR2, and a VL CDR3 having an amino acid sequence of a VL CDR1, a VL CDR2, and a VL CDR3, respectively, of SEQ ID NO:4826. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:4859; and (ii) a VL comprising a VL CDR1, a VL CDR2, and a VL CDR3 having an amino acid sequence of a VL CDR1, a VL CDR2, and a VL CDR3, respectively, of SEQ ID NO:4860. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:4893; and (ii) a VL comprising a VL CDR1, a VL CDR2, and a VL CDR3 having an amino acid sequence of a VL CDR1, a VL CDR2, and a VL CDR3, respectively, of SEQ ID NO:4894. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:4927; and (ii) a VL comprising a VL CDR1, a VL CDR2, and a VL CDR3 having an amino acid sequence of a VL CDR1, a VL CDR2, and a VL CDR3, respectively, of SEQ ID NO:4928. In one embodiment, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:4961; and (ii) a VL comprising a VL CDR1, a VL CDR2, and a VL CDR3 having an amino acid sequence of a VL CDR1, a VL CDR2, and a VL CDR3, respectively, of SEQ ID NO:4962.

In some embodiments, the VH CDR1, VH CDR2, VH CDR3, VL CDR1, VL CDR2, and VL CDR3 amino acid sequences of the CD4 antibody are according to the Kabat numbering system. In some embodiments, the VH CDR1, VH CDR2, VH CDR3, VL CDR1, VL CDR2, and VL CDR3 amino acid sequences of the CD4 antibody are according to the Chothia numbering system. In some embodiments, the VH CDR1, VH CDR2, VH CDR3, VL CDR1, VL CDR2, and VL CDR3 amino acid sequences of the CD4 antibody are according to the AbM numbering system. In some embodiments, the VH CDR1, VH CDR2, VH CDR3, VL CDR1, VL CDR2, and VL CDR3 amino acid sequences of the CD4 antibody are according to the Contact numbering system. In some embodiments, the VH CDR1, VH CDR2, VH CDR3, VL CDR1, VL CDR2, and VL CDR3 amino acid sequences of the CD4 antibody are according to the IMGT numbering system.

In some embodiments, the antibody binds a CD4 antigen. In some embodiments, antibody binds a CD4 epitope. In some embodiments, the antibody specifically binds to CD4. In some embodiments, the VH CDR1, VH CDR2, VH CDR3, VL CDR1, VL CDR2 and VL CDR3 form a binding site for an antigen of the CD4. In some embodiments, the VH CDR1, VH CDR2, VH CDR3, VL CDR1, VL CDR2 and VL CDR3 form a binding site for an epitope of the CD4. In some embodiments, the CD4 is present on the surface of a T cell.

In some embodiments, the CD4 antibody is a humanized antibody. In some embodiments, the antibody is an IgG antibody. In some embodiments, the CD4 antibody is an IgG1 antibody. In some embodiments, the CD4 antibody is an IgG2 antibody. In some embodiments, the CD4 antibody is an IgG3 antibody. In some embodiments, the CD4 antibody is an IgG4 antibody. In some embodiments, the CD4 antibody comprises a kappa light chain. In some embodiments, the CD4 the antibody comprises a lambda light chain. In some embodiments, the CD4 antibody is a monoclonal antibody. In some embodiments, the CD4 antibody is multivalent. In some embodiments, the CD4 antibody is capable of binding at least four antigens. In some embodiments, the CD4 antibody is capable of binding at least five antigens. In some embodiments, the CD4 antibody is a multispecific antibody. In some embodiments, the CD4 antibody is a bispecific antibody. In some embodiments, the CD4 antibody is a trispecific antibody. In some embodiments, the CD4 antibody is a quadraspecific antibody.

In some embodiments, the multispecific CD4 antibody comprises: (i) a first binding domain that binds CD4, and a second binding domain that binds to a second target; (ii) a first binding domain that binds CD4, a second binding domain that binds to a second target, and a third binding domain that binds to a third target; or (iii) a first binding domain that binds CD4, and a second binding domain that binds to a second target, a third binding domain that binds to a third target, and a fourth binding domain that binds to a fourth target. In some embodiments, the second target is CD8. In some embodiments, the second target is CD8 and the second binding domain binds CD8α. In some embodiments, the second target is CD8 and the second binding domain binds CD8β. In some embodiments, the second target is CD8 and the second binding domain binds at the interface of CD8α and CD8β. In some embodiments, the second target is a T cell receptor (TCR) complex, CD3, CD3ε, CD3γ, CD3δ, CD3ζ, a TCRα chain, a TCRβ chain, a TCRγ chain, or a TCRδ chain. In some embodiments, the second target is a T cell costimulatory molecule, CD28, CTLA4, ICOS, 4-1BB, GITR, CD27, OX40, CD40L, HVEM, Galectin-9, TIM-1, LFA1, CD2, or PD1. In some embodiments, the second target is CD8; and the third target is a TCR complex, CD3, CD3ε, CD3γ, CD3δ, CD3ζ, a TCRα chain, a TCRβ chain, a TCRγ chain, a TCRδ chain. In some embodiments, the second target is CD8; and the third target is a T cell costimulatory molecule, CD28, CTLA4, ICOS, 4-1BB, GITR, CD27, OX40, CD40L, HVEM, Galectin-9, TIM-1, LFA1, CD2, or PD1. In some embodiments, the second target is a TCR complex, CD3, CD3ε, CD3γ, CD3δ, CD3ζ, a TCRα chain, a TCRβ chain, a TCRγ chain, or a TCRδ chain; and the third target is a T cell costimulatory molecule, CD28, CTLA4, ICOS, 4-1BB, GITR, CD27, OX40, CD40L, HVEM, Galectin-9, TIM-1, LFA1, CD2, or PD1. In some embodiments, the second target is CD8; wherein the third target is a TCR complex, CD3, CD3ε, CD3γ, CD3δ, CD3ζ, a TCRα chain, a TCRβ chain, a TCRγ chain, or a TCRδ chain; and wherein the fourth target is a T cell costimulatory molecule, CD28, CTLA4, ICOS, 4-1BB, GITR, CD27, OX40, CD40L, HVEM, Galectin-9, TIM-1, LFA1, CD2, or PD1.

Also provided herein is a multispecific CD4 antibody, wherein the multispecific CD4 antibody comprises: a first binding domain that binds CD4, and a second binding domain that binds to a second target, a third binding domain that binds to a third target, and a fourth binding domain that binds to a fourth target. In some embodiments, the second target is CD8, the third target is a TCR complex, and the fourth target is a T cell costimulatory molecule. In some embodiments, the third target is CD3. In some embodiments, the third target is CD3ε. In some embodiments, the third target is CD3γ. In some embodiments, the third target is CD3δ. In some embodiments, the third target is CD3ζ. In some embodiments, the third target is a TCRα chain. In some embodiments, the third target is a TCRβ chain. In some embodiments, the third target is a TCRγ chain. In some embodiments, the third target is a TCRδ chain. In some embodiments, the fourth target is CD28. In some embodiments, the fourth target is CTLA4. In some embodiments, the fourth target is ICOS. In some embodiments, the fourth target is 4-1BB. In some embodiments, the fourth target is GITR. In some embodiments, the fourth target is CD27. In some embodiments, the fourth target is OX40. In some embodiments, the fourth target is CD40L. In some embodiments, the fourth target is HVEM. In some embodiments, the fourth target is Galectin-9. In some embodiments, the fourth target is TIM-1. In some embodiments, the fourth target is LFA1. In some embodiments, the fourth target is CD2. In some embodiments, the fourth target is PD1.

Also provided herein is a multispecific CD4 antibody, wherein the multispecific CD4 antibody comprises: a first binding domain that binds CD4, and a second binding domain that binds to CD8.

Also provided herein is a multispecific CD4 antibody, wherein the multispecific CD4 antibody comprises a first binding domain that binds CD4, a second binding domain that binds to a second target, and a third binding domain that binds to a third target. In some embodiments, the second target is a TCR complex, and the third target is a T cell costimulatory molecule. In some embodiments, the second target is CD3. In some embodiments, the second target is CD3ε. In some embodiments, the second target is CD3γ. In some embodiments, the second target is CD3δ. In some embodiments, the second target is CD3ζ. In some embodiments, the second target is a TCRα chain. In some embodiments, the second target is a TCRβ chain. In some embodiments, the second target is a TCRγ chain. In some embodiments, the second target is a TCRδ chain. In some embodiments, the third target is CD28. In some embodiments, the third target is CTLA4. In some embodiments, the third target is ICOS. In some embodiments, the third target is 4-1BB. In some embodiments, the third target is GITR. In some embodiments, the third target is CD27. In some embodiments, the third target is OX40. In some embodiments, the third target is CD40L. In some embodiments, the third target is HVEM. In some embodiments, the third target is Galectin-9. In some embodiments, the third target is TIM-1. In some embodiments, the third target is LFA1. In some embodiments, the third target is CD2. In some embodiments, the third target is PD1.

In another aspect, provided is a nucleic acid encoding a CD4 antibody provided herein. Also provided is a vector comprising a nucleic acid encoding a CD4 antibody provided herein. Also provided is a host cell comprising a vector comprising a nucleic acid encoding a CD4 antibody provided herein. Also provided is a kit comprising vector comprising a nucleic acid encoding a CD4 antibody provided herein, and packaging for the same.

In another aspect, provided is a kit comprising a CD4 antibody provided herein, and packaging for the same.

In another aspect, provided is a pharmaceutical composition comprising a CD4 antibody provided herein, and a pharmaceutically acceptable carrier.

In another aspect, provided is a method of producing a pharmaceutical composition comprising a CD4 antibody provided herein, comprising combining the CD4 antibody with a pharmaceutically acceptable carrier to obtain the pharmaceutical composition.

In another aspect, provided is a method of activating a T cell expressing CD4, comprising contacting the T cell with a CD4 antibody provided herein. In certain embodiments, the contacting results in an increase in CD69, CD25, and/or Granzyme B expression, as compared to a control T cell expressing CD4.

In another aspect, provided is a method of enriching, isolating, separating, purifying, sorting, selecting, capturing or detecting a CD4-expressing cell comprising: providing a sample comprising the CD4-expressing cell; contacting the sample with the CD4 antibody provided herein; and enriching, isolating, separating, purifying, sorting, selecting, capturing or detecting the CD4-expressing cell bound to the CD4 antibody. In another aspect, provided is a method of enriching, isolating, separating, purifying, sorting, selecting, capturing or detecting a CD4-expressing cell comprising: contacting a CD4-expressing cell with the CD4 antibody provided herein; and enriching, isolating, separating, purifying, sorting, selecting, capturing or detecting the CD4-expressing cell bound to the CD4 antibody. In another aspect, provided is a method of enriching, isolating, separating, purifying, sorting, selecting, capturing or detecting a CD4-expressing cell comprising: contacting a CD4-expressing cell with the CD4 antibody provided herein; and enriching, isolating, separating, purifying, sorting, selecting, capturing or detecting the CD4-expressing cell based on binding of the CD4-expressing cell to the CD4 antibody. In some embodiments, the CD4-expressing cell is a T cell. In some embodiments, the CD4-expressing cell is a CD4+ T helper cell. In some embodiments, the CD4-expressing cell is provided as a sample comprising a population of cells. In some embodiments, the cells are lymphocytes. In some embodiments, the cells are T cells. In some embodiments, the sample is a blood sample. In some embodiments, the sample is a tissue sample. In some embodiments, the CD4 antibody is a multispecific CD4 antibody provided herein.

In another aspect, provided is a multispecific antibody, wherein the multispecific antibody comprises: a first binding domain that binds to CD8 and a second binding domain that binds to CD4 (i.e., a multispecific CD4/CD8 antibody). In a certain embodiments, the first binding domain that binds to CD8 is a CD8 antibody provided herein. In other embodiments, the second binding domain that binds to CD4 is a CD4 antibody provided herein. In specific embodiments, the first binding domain that binds to CD8 is a CD8 antibody provided herein, and the second binding domain that binds to CD4 is a CD4 antibody provided herein. In certain embodiments, the multispecific antibody further binds a third target as provided herein. In other embodiments, the multispecific antibody further binds a third target as provided herein and a fourth target as provided herein.

In some embodiments of multispecific CD4/CD8 antibody provided herein, the VH CDR1, VH CDR2, VH CDR3, VL CDR1, VL CDR2, and VL CDR3 amino acid sequences are according to the Kabat numbering system. In some embodiments, the VH CDR1, VH CDR2, VH CDR3, VL CDR1, VL CDR2, and VL CDR3 amino acid sequences are according to the Chothia numbering system. In some embodiments, the VH CDR1, VH CDR2, VH CDR3, VL CDR1, VL CDR2, and VL CDR3 amino acid sequences are according to the AbM numbering system. In some embodiments, the VH CDR1, VH CDR2, VH CDR3, VL CDR1, VL CDR2, and VL CDR3 amino acid sequences are according to the Contact numbering system. In some embodiments, the VH CDR1, VH CDR2, VH CDR3, VL CDR1, VL CDR2, and VL CDR3 amino acid sequences are according to the IMGT numbering system.

In some embodiments of multispecific CD4/CD8 antibody provided herein, the antibody is a humanized antibody. In some embodiments, the antibody is an IgG antibody. In some embodiments, the IgG antibody is an IgG1, IgG2, IgG3, or IgG4 antibody. In some embodiments, the antibody comprises a kappa light chain. In some embodiments, the antibody comprises a lambda light chain. In some embodiments, the antibody is a monoclonal antibody.

In some embodiments of multispecific CD4/CD8 antibody provided herein, the first binding domain binds a CD8 antigen. In some embodiments, the first binding domain binds a CD8 epitope. In some embodiments, the first binding domain specifically binds to CD8. In some embodiments, the VH CDR1, VH CDR2, VH CDR3, VL CDR1, VL CDR2 and VL CDR3 of the first binding domain form a binding site for an antigen of the CD8. In some embodiments, the VH CDR1, VH CDR2, VH CDR3, VL CDR1, VL CDR2 and VL CDR3 of the first binding domain form a binding site for an epitope of the CD8. In some embodiments, the CD8 is present on the surface of a T cell.

In some embodiments of multispecific CD4/CD8 antibody provided herein, the second binding domain binds a CD4 antigen. In some embodiments, the second binding domain binds a CD4 epitope. In some embodiments, the second binding domain specifically binds to CD4. In some embodiments, the VH CDR1, VH CDR2, VH CDR3, VL CDR1, VL CDR2 and VL CDR3 of the second binding domain form a binding site for an antigen of the CD4. In some embodiments, the VH CDR1, VH CDR2, VH CDR3, VL CDR1, VL CDR2 and VL CDR3 of the second binding domain form a binding site for an epitope of the CD4. In some embodiments, the CD4 is present on the surface of a T cell.

In some embodiments of multispecific CD4/CD8 antibody provided herein, the antibody is multivalent. In some embodiments, the antibody is capable of binding at least three antigens. In some embodiments, the antibody is capable of binding at least four antigens. In some embodiments, the antibody is capable of binding at least five antigens.

In some embodiments of multispecific CD4/CD8 antibody provided herein, the antibody is a bispecific antibody. In some embodiments, the antibody is a trispecific antibody. In some embodiments, the antibody is a quadraspecific antibody.

In some embodiments of multispecific CD4/CD8 antibody provided herein, the multispecific antibody further comprises: a third binding domain that binds to a third target. In some embodiments, the third target is a TCR complex. In some embodiments, the third target is CD3. In some embodiments, the third target is CD3ε. In some embodiments, the third target is CD3γ. In some embodiments, the third target is CD3δ. In some embodiments, the third target is CD3ζ. In some embodiments, the third target is a TCRα chain. In some embodiments, the third target is a TCRβ chain. In some embodiments, the third target is a TCRγ chain. In some embodiments, the third target is a TCRδ chain. In some embodiments, the third target is CD28. In some embodiments, the third target is CTLA4. In some embodiments, the third target is ICOS. In some embodiments, the third target is 4-1BB. In some embodiments, the third target is GITR. In some embodiments, the third target is CD27. In some embodiments, the third target is OX40. In some embodiments, the third target is CD40L. In some embodiments, the third target is HVEM. In some embodiments, the third target is Galectin-9. In some embodiments, the third target is TIM-1. In some embodiments, the third target is LFA1. In some embodiments, the third target is CD2. In some embodiments, the third target is PD1.

In some embodiments of multispecific CD4/CD8 antibody provided herein, the multispecific antibody further comprises: a third binding domain that binds to a third target, and a fourth binding domain that binds to a fourth target. In some embodiments, the third target is a TCR complex. In some embodiments, the third target is CD3. In some embodiments, the third target is CD3ε. In some embodiments, the third target is CD3γ. In some embodiments, the third target is CD3δ. In some embodiments, the third target is CD3ζ. In some embodiments, the third target is a TCRα chain. In some embodiments, the third target is a TCRβ chain. In some embodiments, the third target is a TCRγ chain. In some embodiments, the third target is a TCRδ chain. In some embodiments, the fourth target is CD28. In some embodiments, the fourth target is CTLA4. In some embodiments, the fourth target is ICOS. In some embodiments, the fourth target is 4-1BB. In some embodiments, the fourth target is GITR. In some embodiments, the fourth target is CD27. In some embodiments, the fourth target is OX40. In some embodiments, the fourth target is CD40L. In some embodiments, the fourth target is HVEM. In some embodiments, the fourth target is Galectin-9. In some embodiments, the fourth target is TIM-1. In some embodiments, the fourth target is LFA1. In some embodiments, the fourth target is CD2. In some embodiments, the fourth target is PD1.

In another aspect, provided is a nucleic acid encoding a multispecific CD4/CD8 antibody provided herein. Also provided is a vector comprising a nucleic acid encoding a multispecific CD4/CD8 antibody provided herein. Also provided is a host cell comprising a vector comprising a nucleic acid encoding a multispecific CD4/CD8 antibody provided herein. Also provided is a kit comprising vector comprising a nucleic acid encoding a multispecific CD4/CD8 antibody provided herein, and packaging for the same.

In another aspect, provided is a kit comprising a multispecific CD4/CD8 antibody provided herein, and packaging for the same.

In another aspect, provided is a pharmaceutical composition comprising a multispecific CD4/CD8 antibody provided herein, and a pharmaceutically acceptable carrier.

In another aspect, provided is a method of producing a pharmaceutical composition comprising a multispecific CD4/CD8 antibody provided herein, comprising combining the multispecific CD4/CD8 antibody with a pharmaceutically acceptable carrier to obtain the pharmaceutical composition.

In another aspect, provided is a method of enriching, isolating, separating, purifying, sorting, selecting, capturing or detecting CD4-expressing cells and/or CD8-expressing cells comprising: providing a sample comprising the CD4-expressing cells and/or CD8-expressing cells; contacting the sample with the multispecific CD4/CD8 antibody provided herein; and enriching, isolating, separating, purifying, sorting, selecting, capturing or detecting the CD4-expressing cells and/or CD8-expressing cells bound to the multispecific CD4/CD8 antibody. In another aspect, provided is a method of enriching, isolating, separating, purifying, sorting, selecting, capturing or detecting a CD4-expressing cells and/or CD8-expressing cells comprising: contacting a CD4-expressing cells and/or CD8-expressing cells with the multispecific CD4/CD8 antibody provided herein; and enriching, isolating, separating, purifying, sorting, selecting, capturing or detecting the CD4-expressing cells and/or CD8-expressing cells based on binding of the CD4-expressing cells and/or CD8-expressing cells to the multispecific CD4/CD8 antibody. In some embodiments, the CD4-expressing cells and/or CD8-expressing cells is a T cell. In some embodiments, the CD4-expressing cells and/or CD8-expressing cells is a CD4+ T helper cell. In some embodiments, the CD4-expressing cells and/or CD8-expressing cells is provided as a sample comprising a population of cells. In some embodiments, the cells are lymphocytes. In some embodiments, the cells are T cells. In some embodiments, the sample is a blood sample. In some embodiments, the sample is a tissue sample. In some embodiments, the multispecific CD4/CD8 antibody is a multispecific CD4/CD8 antibody provided herein. In some embodiments, the cells comprise CD4-expressing cells. In some embodiments, the cells comprise CD8-expressing cells. In some embodiments, the cells comprise CD4-expressing cells and CD8-expressing cells.

DETAILED DESCRIPTION

Various publications, articles and patents are cited or described in the background and throughout the specification; each of these references is herein incorporated by reference in its entirety. Discussion of documents, acts, materials, devices, articles or the like which has been included in the present specification is for the purpose of providing context for the invention. Such discussion is not an admission that any or all of these matters form part of the prior art with respect to any inventions disclosed or claimed.

Unless defined otherwise, all technical and scientific terms used herein have the same meaning as commonly understood to one of ordinary skill in the art to which this invention pertains. Otherwise, certain terms used herein have the meanings as set forth in the specification.

It must be noted that as used herein and in the appended claims, the singular forms "a," "an," and "the" include plural reference unless the context clearly dictates otherwise.

Unless otherwise stated, any numerical values, such as a concentration or a concentration range described herein, are to be understood as being modified in all instances by the term "about." Thus, a numerical value typically includes ±10% of the recited value. For example, a concentration of 1 mg/mL includes 0.9 mg/mL to 1.1 mg/mL. Likewise, a concentration range of 1% to 10% (w/v) includes 0.9% (w/v) to 11% (w/v). As used herein, the use of a numerical range expressly includes all possible subranges, all individual numerical values within that range, including integers within such ranges and fractions of the values unless the context clearly indicates otherwise.

Unless otherwise indicated, the term "at least" preceding a series of elements is to be understood to refer to every element in the series.

Those skilled in the art will recognize or be able to ascertain using no more than routine experimentation, many equivalents to the specific embodiments described herein. Such equivalents are intended to been compassed by the invention.

As used herein, the terms "comprises," "comprising," "includes," "including," "has," "having," "contains" or "containing," or any other variation thereof, will be understood to imply the inclusion of a stated integer or group of integers but not the exclusion of any other integer or group of integers and are intended to be non-exclusive or open-ended. For example, a composition, a mixture, a process, a method, an article, or an apparatus that comprises a list of elements is not necessarily limited to only those elements but can include other elements not expressly listed or inherent to such composition, mixture, process, method, article, or apparatus. Further, unless expressly stated to the contrary, "or" refers to an inclusive or and not to an exclusive or. For example, a condition A or B is satisfied by any one of the following: A is true (or present) and B is false (or not present), A is false (or not present) and B is true (or present), and both A and B are true (or present).

As used herein, the conjunctive term "and/or" between multiple recited elements is understood as encompassing both individual and combined options. For instance, where two elements are conjoined by "and/or," a first option refers to the applicability of the first element without the second. A second option refers to the applicability of the second element without the first. A third option refers to the applicability of the first and second elements together. Any one of these options is understood to fall within the meaning, and therefore satisfy the requirement of the term "and/or" as used herein. Concurrent applicability of more than one of the options is also understood to fall within the meaning, and therefore satisfy the requirement of the term "and/or."

As used herein, the term "consists of," or variations such as "consist of" or "consisting of," as used throughout the specification and claims, indicate the inclusion of any recited integer or group of integers, but that no additional integer or group of integers can be added to the specified method, structure, or composition.

As used herein, the term "consists essentially of," or variations such as "consist essentially of" or "consisting essentially of," as used throughout the specification and claims, indicate the inclusion of any recited integer or group of integers, and the optional inclusion of any recited integer or group of integers that do not materially change the basic or novel properties of the specified method, structure or composition. See M.P.E.P. § 2111.03.

As used herein, "subject" means any animal, preferably a mammal, most preferably a human. The term "mammal" as used herein, encompasses any mammal. Examples of mammals include, but are not limited to, cows, horses, sheep, pigs, cats, dogs, mice, rats, rabbits, guinea pigs, monkeys, humans, etc. In a specific embodiments, the subject is a human.

It should also be understood that the terms "about," "approximately," "generally," "substantially," and like terms, used herein when referring to a dimension or characteristic of a component of embodiments provided herein, indicate that the described dimension/characteristic is not a strict boundary or parameter and does not exclude minor variations therefrom that are functionally the same or similar, as would be understood by one having ordinary skill in the art. At a minimum, such references that include a numerical parameter would include variations that, using mathematical and industrial principles accepted in the art (e.g., rounding, measurement or other systematic errors, manufacturing tolerances, etc.), would not vary the least significant digit.

The terms "identical" or percent "identity," in the context of two or more nucleic acids or polypeptide sequences (e.g., CD8 antibody and polynucleotides that encode them, CD4 antibody and polynucleotides that encode them, multispecific CD4/CD8 antibodies and polynucleotides that encode them), refer to two or more sequences or subsequences that are the same or have a specified percentage of amino acid residues or nucleotides that are the same, when compared and aligned for maximum correspondence, as measured using one of the following sequence comparison algorithms or by visual inspection.

For sequence comparison, typically one sequence acts as a reference sequence, to which test sequences are compared. When using a sequence comparison algorithm, test and reference sequences are input into a computer, subsequence coordinates are designated, if necessary, and sequence algorithm program parameters are designated. The sequence comparison algorithm then calculates the percent sequence identity for the test sequence(s) relative to the reference sequence, based on the designated program parameters.

Optimal alignment of sequences for comparison can be conducted, e.g., by the local homology algorithm of Smith & Waterman, Adv. Appl. Math. 2:482 (1981), by the homology alignment algorithm of Needleman & Wunsch, J. Mol. Biol. 48:443 (1970), by the search for similarity method of Pearson & Lipman, Proc. Nat'l. Acad. Sci. USA 85:2444 (1988), by computerized implementations of these algorithms (GAP, BESTFIT, FASTA, and TFASTA in the Wisconsin Genetics Software Package, Genetics Computer Group, 575 Science Dr., Madison, WI), or by visual inspection (see generally, Current Protocols in Molecular Biology, F. M. Ausubel et al., eds., Current Protocols, a joint venture between Greene Publishing Associates, Inc. and John Wiley & Sons, Inc., (1995 Supplement) (Ausubel)).

Examples of algorithms that are suitable for determining percent sequence identity and sequence similarity are the BLAST and BLAST 2.0 algorithms, which are described in Altschul et al. (1990) J. Mol. Biol. 215: 403-410 and Altschul et al. (1997) Nucleic Acids Res. 25: 3389-3402, respectively. Software for performing BLAST analyses is publicly available through the National Center for Biotechnology Information. This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al., supra). These initial neighborhood word hits act as seeds for initiating searches to find longer HSPs containing them. The word hits are then extended in both directions along each sequence for as far as the cumulative alignment score can be increased.

Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a word length (W) of 11, an expectation (E) of 10, M=5, N=−4, and a comparison of both strands. For amino acid sequences, the BLASTP program uses as defaults a word length (W) of 3, an expectation (E) of 10, and the BLOSUM62 scoring matrix (see Henikoff & Henikoff, Proc. Natl. Acad. Sci. USA 89:10915 (1989)).

In addition to calculating percent sequence identity, the BLAST algorithm also performs a statistical analysis of the similarity between two sequences (see, e.g., Karlin & Altschul, Proc. Nat'l. Acad. Sci. USA 90:5873-5787 (1993)). One measure of similarity provided by the BLAST algorithm is the smallest sum probability (P(N)), which provides an indication of the probability by which a match between two nucleotide or amino acid sequences would occur by chance. For example, a nucleic acid is considered similar to a reference sequence if the smallest sum probability in a comparison of the test nucleic acid to the reference nucleic acid is less than about 0.1, more preferably less than about 0.01, and most preferably less than about 0.001.

A further indication that two nucleic acid sequences or polypeptides are substantially identical is that the polypeptide encoded by the first nucleic acid is immunologically cross reactive with the polypeptide encoded by the second nucleic acid, as described below. Thus, a polypeptide is typically substantially identical to a second polypeptide, for example, where the two peptides differ only by conservative substitutions. Another indication that two nucleic acid sequences are substantially identical is that the two molecules hybridize to each other under stringent conditions.

As used herein, the term "polynucleotide," synonymously referred to as "nucleic acid molecule," "nucleotides" or "nucleic acids," refers to any polyribonucleotide or polydeoxyribonucleotide, which can be unmodified RNA or DNA or modified RNA or DNA. "Polynucleotides" include, without limitation single- and double-stranded DNA, DNA that is a mixture of single- and double-stranded regions, single- and double-stranded RNA, and RNA that is mixture of single- and double-stranded regions, hybrid molecules comprising DNA and RNA that can be single-stranded or, more typically, double-stranded or a mixture of single- and double-stranded regions. In addition, "polynucleotide" refers to triple-stranded regions comprising RNA or DNA or both RNA and DNA. The term polynucleotide also includes DNAs or RNAs containing one or more modified bases and DNAs or RNAs with backbones modified for stability or for other reasons. "Modified" bases include, for example, tritylated bases and unusual bases such as inosine. A variety of modifications can be made to DNA and RNA; thus, "polynucleotide" embraces chemically, enzymatically or metabolically modified forms of polynucleotides as typically found in nature, as well as the chemical forms of DNA and RNA characteristic of viruses and cells. "Polynucleotide" also embraces relatively short nucleic acid chains, often referred to as oligonucleotides.

As used herein, the term "vector" is a replicon in which another nucleic acid segment can be operably inserted so as to bring about the replication or expression of the segment.

As used herein, the term "host cell" refers to a cell comprising a nucleic acid molecule provided herein. The "host cell" can be any type of cell, e.g., a primary cell, a cell in culture, or a cell from a cell line. In one embodiment, a "host cell" is a cell transfected with a nucleic acid molecule provided herein. In another embodiment, a "host cell" is a progeny or potential progeny of such a transfected cell. A progeny of a cell may or may not be identical to the parent cell, e.g., due to mutations or environmental influences that can occur in succeeding generations or integration of the nucleic acid molecule into the host cell genome.

The term "expression" as used herein, refers to the biosynthesis of a gene product. The term encompasses the transcription of a gene into RNA. The term also encompasses translation of RNA into one or more polypeptides, and further encompasses all naturally occurring post-transcriptional and post-translational modifications. The expressed antibody can be within the cytoplasm of a host cell, into the extracellular milieu such as the growth medium of a cell culture or anchored to the cell membrane.

As used herein, the terms "peptide," "polypeptide," or "protein" can refer to a molecule comprised of amino acids and can be recognized as a protein by those of skill in the art. The conventional one-letter or three-letter code for amino acid residues is used herein. The terms "peptide," "polypeptide," and "protein" can be used interchangeably herein to refer to polymers of amino acids of any length. The polymer can be linear or branched, it can comprise modified amino acids, and it can be interrupted by non-amino acids. The terms also encompass an amino acid polymer that has been modified naturally or by intervention; for example, disulfide bond formation, glycosylation, lipidation, acetylation, phosphorylation, or any other manipulation or modification, such as conjugation with a labeling component. Also included within the definition are, for example, polypeptides containing one or more analogs of an amino acid (including, for example, unnatural amino acids, etc.), as well as other modifications known in the art.

The peptide sequences described herein are written according to the usual convention whereby the N-terminal region of the peptide is on the left and the C-terminal region is on the right. Although isomeric forms of the amino acids are known, it is the L-form of the amino acid that is represented unless otherwise expressly indicated.

Antibodies

Provided herein are CD8 antibodies or antigen-binding fragments thereof, nucleic acids and expression vectors encoding the antibodies, recombinant cells containing the vectors, and compositions comprising the antibodies. Methods of making the antibodies, and methods of using the antibodies to treat diseases are also provided. The antibodies disclosed herein possess one or more desirable functional properties, including but not limited to high-affinity binding to CD8 or high specificity to CD8. In certain embodiments, the antibodies disclosed herein possess the ability to treat or prevent a disease or disorder when administered to a subject alone or in combination with other therapies.

Also provided herein are CD8 multispecific antibodies or antigen-binding fragments thereof, nucleic acids and expression vectors encoding the multispecific antibodies, recombinant cells containing the vectors, and compositions comprising the multispecific antibodies. Methods of making the antibodies, and methods of using the multispecific antibodies to treat diseases, including cancer, are also provided. The antibodies disclosed herein possess one or more desirable functional properties. In some embodiments, the multispecific antibodies provided herein have high-affinity binding to CD8. In some embodiments, the multispecific antibodies provided herein have high-affinity binding to a second target antigen. In some embodiments, the multispecific antibodies provided herein have high specificity to CD8. In some embodiments, the multispecific antibodies provided herein have high specificity to a second target antigen. In some embodiments, the multispecific antibodies provided herein have the ability to treat or prevent a disease or disorder when administered alone. In some embodiments, the multispecific antibodies provided herein have the ability to treat or prevent a disease or disorder when administered in combination with other therapies. In certain embodiments, the multispecific antibody is a bispecific antibody. In some embodiments, the multispecific antibody is a trispecific antibody. In some embodiments, the multispecific antibody is a quadraspecific antibody. In certain embodiments, the second target is CD4.

Also provided herein are CD4 antibodies or antigen-binding fragments thereof, nucleic acids and expression vectors encoding the antibodies, recombinant cells containing the vectors, and compositions comprising the antibodies. Methods of making the antibodies, and methods of using the antibodies to treat diseases are also provided. The antibodies disclosed herein possess one or more desirable functional properties, including but not limited to high-affinity binding to CD4 or high specificity to CD4. In certain embodiments, the antibodies disclosed herein possess the ability to treat or prevent a disease or disorder when administered to a subject alone or in combination with other therapies.

Also provided herein are CD4 multispecific antibodies or antigen-binding fragments thereof, nucleic acids and expression vectors encoding the multispecific antibodies, recombinant cells containing the vectors, and compositions comprising the multispecific antibodies. Methods of making the antibodies, and methods of using the multispecific antibodies to treat diseases, including cancer, are also provided. The antibodies disclosed herein possess one or more desirable functional properties. In some embodiments, the multispecific antibodies provided herein have high-affinity binding to CD4. In some embodiments, the multispecific antibodies provided herein have high-affinity binding to a second target antigen. In some embodiments, the multispecific antibodies provided herein have high specificity to CD4. In some embodiments, the multispecific antibodies provided herein have high specificity to a second target antigen. In some embodiments, the multispecific antibodies provided herein have the ability to treat or prevent a disease or disorder when administered alone. In some embodiments, the multispecific antibodies provided herein have the ability to treat or prevent a disease or disorder when administered in combination with other therapies. In certain embodiments, the multispecific antibody is a bispecific antibody. In some embodiments, the multispecific antibody is a trispecific antibody. In some embodiments, the multispecific antibody is a quadraspecific antibody. In certain embodiments, the second target is CD8.

As used herein, the term "antibody" is used in a broad sense and includes immunoglobulin or antibody molecules including human, humanized, composite and chimeric antibodies and antibody fragments that are monoclonal or polyclonal. In general, antibodies are proteins or peptide chains that exhibit binding specificity to a specific antigen. Antibody structures are well known. Immunoglobulins can be assigned to five major classes (i.e., IgA, IgD, IgE, IgG and IgM), depending on the heavy chain constant domain amino acid sequence. IgA and IgG are further sub-classified as the isotypes IgA1, IgA2, IgG1, IgG2, IgG3 and IgG4. Accordingly, the antibodies provided herein can be of any of the five major classes or corresponding sub-classes. In specific embodiments, the antibodies provided herein are IgG1, IgG2, IgG3 or IgG4. Antibody light chains of vertebrate species can be assigned to one of two clearly distinct types, namely kappa and lambda, based on the amino acid sequences of their constant domains. Accordingly, the antibodies provided herein can, in certain embodiments, contain a kappa light chain constant domain. The antibodies provided herein can, in certain embodiments, also contain a lambda light chain constant domain. According to particular embodiments, the antibodies provided herein include heavy and/or light chain constant regions from rat or human antibodies. In specific embodiments, the constant region is a human constant region.

In addition to the heavy and light constant domains, antibodies contain an antigen-binding region that is made up of a light chain variable region (VL) and a heavy chain variable region (VH), each of which contains three domains (i.e., complementarity determining regions 1 (CDR1), CDR2 and CDR3. A "CDR" refers to one of three hypervariable regions (HCDR1, HCDR2 or HCDR3) within the non-framework region of the immunoglobulin (Ig or antibody) VH β-sheet framework, or one of three hypervariable regions (LCDR1, LCDR2 or LCDR3) within the non-framework region of the antibody VL β-sheet framework. Accordingly, CDRs are variable region sequences interspersed within the framework region sequences. CDR regions are well known to those skilled in the art and have been defined by, for example, Kabat as the regions of most hypervariability within the antibody variable (V) domains (Kabat et al., *J. Biol. Chem.* 252:6609-6616 (1977); Kabat, *Adv. Prot. Chem.* 32:1-75 (1978)). CDR region sequences also have been defined structurally by Chothia as those residues that are not part of the conserved β-sheet framework, and thus are able to adapt different conformations (Chothia and Lesk, *J. Mol. Biol.* 196:901-917 (1987)). Both terminologies are well recognized in the art. CDR region sequences have also been defined by AbM, Contact and IMGT. Exemplary CDR region sequences are illustrated herein, for example, in the tables provided in the Examples below. The positions of CDRs within a canonical antibody variable region have been determined by comparison of numerous structures (Al-Lazikani et al., *J. Mol. Biol.* 273:927-948 (1997); Morea et al., *Methods* 20:267-279 (2000)). Because the number of residues within a hypervariable region varies in different antibodies, additional residues relative to the canonical positions are conventionally numbered with a, b, c and so forth next to the residue number in the canonical variable region numbering scheme (Al-Lazikani et al., supra (1997)). Such nomenclature is similarly well known to those skilled in the art.

The light chain variable region CDR1 domain is interchangeably referred to herein as LCDR1 or VL CDR1. The light chain variable region CDR2 domain is interchangeably referred to herein as LCDR2 or VL CDR2. The light chain variable region CDR3 domain is interchangeably referred to herein as LCDR3 or VL CDR3. The heavy chain variable region CDR1 domain is interchangeably referred to herein as HCDR1 or VH CDR1. The heavy chain variable region CDR2 domain is interchangeably referred to herein as HCDR2 or VH CDR2. The heavy chain variable region CDR1 domain is interchangeably referred to herein as HCDR3 or VH CDR3.

The term "hypervariable region", such as a VH or VL, when used herein refers to the regions of an antibody variable region that are hypervariable in sequence and/or form structurally defined loops. Generally, antibodies comprise six hypervariable regions; three in the VH (HCDR1, HCDR2, HCDR3), and three in the VL (LCDR1, LCDR2, LCDR3). A number of hypervariable region delineations are in use and are encompassed herein. The "Kabat" CDRs are based on sequence variability and are the most commonly used (see, e.g., Kabat et al., *Sequences of Proteins of Immunological Interest,* 5th Ed. Public Health Service, National Institutes of Health, Bethesda, MD (1991)). "Chothia" refers instead to the location of the structural loops (see, e.g., Chothia and Lesk, *J. Mol. Biol.* 196:901-917 (1987)). The end of the Chothia CDR-HCDR1 loop when numbered using the Kabat numbering convention varies between H32 and H34 depending on the length of the loop (this is because the Kabat numbering scheme places the insertions at H35A and H35B; if neither 35A nor 35B is present, the loop ends at 32; if only 35A is present, the loop ends at 33; if both 35A and 35B are present, the loop ends at 34). The "AbM" hypervariable regions represent a compromise between the Kabat CDRs and Chothia structural loops, and are used by Oxford Molecular's AbM antibody modeling software (see, e.g., Martin, in *Antibody Engineering,* Vol. 2, Chapter 3, Springer Verlag). "Contact" hypervariable regions are based on an analysis of the available complex crystal structures.

Recently, a universal numbering system has been developed and widely adopted, ImMunoGeneTics (IMGT) Information System® (Lafranc et al., *Dev. Comp. Immunol.* 27(1):55-77 (2003)). IMGT is an integrated information system specializing in immunoglobulins (IG), T cell receptors (TR) and major histocompatibility complex (MHC) of human and other vertebrates. Herein, the CDRs are referred to in terms of both the amino acid sequence and the location within the light or heavy chain. As the "location" of the CDRs within the structure of the immunoglobulin variable domain is conserved between species and present in structures called loops, by using numbering systems that align variable domain sequences according to structural features, CDR and framework residues and are readily identified. This information can be used in grafting and replacement of CDR residues from immunoglobulins of one species into an acceptor framework from, typically, a human antibody. An additional numbering system (AHon) has been developed by Honegger and Pluckthun, *J. Mol. Biol.* 309: 657-670 (2001). Correspondence between the numbering system, including, for example, the Kabat numbering and the IMGT unique numbering system, is well known to one skilled in the art (see, e.g., Kabat, supra; Chothia and Lesk, supra; Martin, supra; Lefranc et al., supra). An Exemplary system, shown herein, combines Kabat and Chothia.

|  | Exemplary | IMGT | Kabat | AbM | Chothia | Contact |
|---|---|---|---|---|---|---|
| $V_H$ CDR1 | 26-35 | 27-38 | 31-35 | 26-35 | 26-32 | 30-35 |
| $V_H$ CDR2 | 50-65 | 56-65 | 50-65 | 50-58 | 53-55 | 47-58 |
| $V_H$ CDR3 | 95-102 | 105-117 | 95-102 | 95-102 | 96-101 | 93-101 |
| $V_L$ CDR1 | 24-34 | 27-38 | 24-34 | 24-34 | 26-32 | 30-36 |
| $V_L$ CDR2 | 50-56 | 56-65 | 50-56 | 50-56 | 50-52 | 46-55 |
| $V_L$ CDR3 | 89-97 | 105-117 | 89-97 | 89-97 | 91-96 | 89-96 |

Hypervariable regions may comprise "extended hypervariable regions" as follows: 24-36 or 24-34 (LCDR1), 46-56 or 50-56 (LCDR2) and 89-97 or 89-96 (LCDR3) in the VL and 26-35 or 26-35A (HCDR1), 50-65 or 49-65 (HCDR2) and 93-102, 94-102, or 95-102 (HCDR3) in the VH. CDR sequences, reflecting each of the above numbering schemes, are provided herein, including in tables of the Examples below.

The term "constant region" or "constant domain" refers to a carboxy terminal portion of the light and heavy chain which is not directly involved in binding of the antibody to antigen but exhibits various effector function, such as interaction with the Fc receptor. The terms refer to the portion of an immunoglobulin molecule having a more conserved amino acid sequence relative to the other portion of the immunoglobulin, the variable region, which contains the antigen binding site. The constant region may contain the CH1, CH2 and CH3 regions of the heavy chain and the CL region of the light chain.

The term "framework" or "FR" residues are those variable region residues flanking the CDRs. FR residues are present, for example, in chimeric, humanized, human, domain antibodies, diabodies, linear antibodies, and bispecific antibodies. FR residues are those variable domain residues other than the hypervariable region residues or CDR residues.

As used herein, the term an "isolated antibody" refers to an antibody which is substantially free of other antibodies having different antigenic specificities (e.g., an isolated antibody that specifically binds to CD8 is substantially free of antibodies that do not bind to CD8; an isolated antibody that specifically binds to CD4 is substantially free of antibodies that do not bind to CD4). In addition, an isolated antibody is substantially free of other cellular material and/or chemicals.

As used herein, the term "monoclonal antibody" refers to an antibody obtained from a population of substantially homogeneous antibodies, i.e., the individual antibodies comprising the population are identical except for possible naturally occurring mutations that can be present in minor amounts. Monoclonal antibodies provided herein can be made by the hybridoma method, phage display technology, single lymphocyte gene cloning technology, or by recombinant DNA methods. For example, the monoclonal antibodies can be produced by a hybridoma which includes a B cell obtained from a transgenic nonhuman animal, such as a transgenic mouse or rat, having a genome comprising a human heavy chain transgene and a light chain transgene.

As used herein, the term "antigen-binding fragment" refers to an antibody fragment such as, for example, a diabody, a Fab, a Fab', a F(ab')2, an Fv fragment, a disulfide stabilized Fv fragment (dsFv), a (dsFv)$_2$, a bispecific dsFv (dsFv-dsFv'), a disulfide stabilized diabody (ds diabody), a single-chain antibody molecule (scFv), a single domain antibody (sdAb) an scFv dimer (bivalent diabody), a multispecific antibody formed from a portion of an antibody comprising one or more CDRs, a camelized single domain antibody, a nanobody, a domain antibody, a bivalent domain antibody, or any other antibody fragment that binds to an antigen but does not comprise a complete antibody structure. An antigen-binding fragment is capable of binding to the same antigen to which the parent antibody or a parent antibody fragment binds. According to particular embodiments, the antigen-binding fragment comprises a light chain variable region, a light chain constant region, and an Fd segment of the heavy chain. According to other particular embodiments, the antigen-binding fragment comprises Fab and F(ab').

As used herein, the term "single-chain antibody" refers to a conventional single-chain antibody in the field, which comprises a heavy chain variable region and a light chain variable region connected by a short peptide of about 15 to about 20 amino acids. As used herein, the term "single domain antibody" refers to a conventional single domain antibody in the field, which comprises a heavy chain variable region and a heavy chain constant region or which comprises only a heavy chain variable region.

As used herein, the term "human antibody" refers to an antibody produced by a human or an antibody having an amino acid sequence corresponding to an antibody produced by a human made using any technique known in the art. This definition of a human antibody includes intact or full-length antibodies, fragments thereof, and/or antibodies comprising at least one human heavy and/or light chain polypeptide.

As used herein, the term "humanized antibody" refers to a non-human antibody that is modified to increase the sequence homology to that of a human antibody, such that the antigen-binding properties of the antibody are retained, but its antigenicity in the human body is reduced.

As used herein, the term "chimeric antibody" refers to an antibody wherein the amino acid sequence of the immunoglobulin molecule is derived from two or more species. The variable region of both the light and heavy chains often corresponds to the variable region of an antibody derived from one species of mammal (e.g., mouse, rat, rabbit, etc.) having the desired specificity, affinity, and capability, while the constant regions correspond to the sequences of an antibody derived from another species of mammal (e.g., human) to avoid eliciting an immune response in that species.

As used herein, the term "multispecific antibody" refers to an antibody that comprises a plurality of immunoglobulin variable domain sequences, wherein a first immunoglobulin variable domain sequence of the plurality has binding specificity for a first epitope and a second immunoglobulin variable domain sequence of the plurality has binding specificity for a second epitope. In an embodiment, the first and second epitopes do not overlap or do not substantially overlap. In an embodiment, the first and second epitopes are on different antigens, e.g., the different proteins (or different subunits of a multimeric protein). In an embodiment, a multispecific antibody comprises a third, fourth, or fifth immunoglobulin variable domain. In an embodiment, a multispecific antibody is a bispecific antibody molecule, a trispecific antibody molecule, or a tetraspecific antibody molecule.

As used herein, the term "bispecific antibody" refers to a multispecific antibody that binds no more than two epitopes or two antigens. A bispecific antibody is characterized by a first immunoglobulin variable domain sequence which has binding specificity for a first epitope (e.g., an epitope on a target antigen) and a second immunoglobulin variable domain sequence that has binding specificity for a second epitope. In an embodiment, the first and second epitopes are on different antigens, e.g., the different proteins (or different subunits of a multimeric protein). In an embodiment, a bispecific antibody comprises a heavy chain variable domain sequence and a light chain variable domain sequence which have binding specificity for a first epitope and a heavy chain variable domain sequence and a light chain variable domain sequence which have binding specificity for a second epitope. In an embodiment, a bispecific antibody comprises a half antibody, or fragment thereof, having binding specificity for a first epitope and a half antibody, or fragment thereof, having binding specificity for a second epitope. In an embodiment, a bispecific antibody comprises a scFv, or fragment thereof, having binding specificity for a first epitope, and a scFv, or fragment thereof, having binding specificity for a second epitope. A "trispecific antibody" is a multispecific antibody that binds three distinct antigens, or three distinct epitopes within the same antigen. A "quadraspecific antibody" is a multispecific antibody that binds four distinct antigens, or four distinct epitopes within the same antigen.

As used herein, the term "CD4" refers to a polypeptide capable of forming a co-receptor with the T cell receptor (TCR) when expressed on the surface of T cells. The term "CD4" includes any CD4 variant, isoform, and species homolog, which is naturally expressed by cells (including T cells) or can be expressed on cells transfected with genes or cDNA encoding the polypeptide. In specific embodiments, the CD4 is a human CD4. An exemplary human CD4 amino acid sequence is provided by GenBank Accession Number NP_000607.1.

As used herein, the term "CD8" refers to a polypeptide capable of forming a co-receptor with the T cell receptor (TCR) when expressed on the surface of T cells. The term "CD8" includes any CD8 variant, isoform, and species homolog, which is naturally expressed by cells (including T cells) or can be expressed on cells transfected with genes or cDNA encoding the polypeptide. In specific embodiments, the CD8 is a human CD8. CD8 can comprise a CD8α chain or a CD8β chain. In certain embodiments, the CD8 comprises a CD8αβ heterodimer. In certain embodiments, CD8 comprises a CD8αα homodimer. In certain embodiments, CD8 comprises a CD8ββ homodimer. An exemplary human CD8α amino acid sequence is provided by GenBank Accession Number AAH25715. An exemplary human CD8β amino acid sequence is provided by GenBank Accession Number AAI00912.

As used herein, an antibody that "specifically binds to CD8" refers to an antibody that binds to a CD8, preferably a human CD8, with a KD of $1\times10^{-7}$ M or less, such as $1\times10^{-8}$ M or less, $5\times10^{-9}$ M or less, $1\times10^{-9}$ M or less, $5\times10^{-10}$ M or less, or $1\times10^{-10}$ M or less. As used herein, an antibody that "specifically binds to CD4" refers to an antibody that binds to a CD4, preferably a human CD4, with a KD of $1\times10^{-7}$ M or less, such as $1\times10^{-8}$ M or less, $5\times10^{-9}$ M or less, $1\times10^{-9}$ M or less, $5\times10^{-10}$ M or less, or $1\times10^{-10}$ M or less. As used herein, an antibody that "specifically binds to a second target antigen" refers to an antibody that binds to a second target antigen with a KD of $1\times10^{-7}$ M or less, such as $1\times10^{-8}$ M or less, $5\times10^{-9}$ M or less, $1\times10^{-9}$ M or less, $5\times10^{-10}$ M or less, or $1\times10^{-10}$ M or less. As used herein, an antibody that "specifically binds to a third target antigen" refers to an antibody that binds to a third target antigen with a KD of $1\times10^{-7}$ M or less, such as $1\times10^{-8}$ M or less, $5\times10^{-9}$ M or less, $1\times10^{-9}$ M or less, $5\times10^{-10}$ M or less, or $1\times10^{-10}$ M or less. As used herein, an antibody that "specifically binds to a fourth target antigen" refers to an antibody that binds to a fourth target antigen with a KD of $1\times10^{-7}$ M or less, such as $1\times10^{-8}$ M or less, $5\times10^{-9}$ M or less, $1\times10^{-9}$ M or less, $5\times10^{-10}$ M or less, or $1\times10^{-10}$ M or less.

The term "KD" refers to the dissociation constant, which is obtained from the ratio of Kd to Ka (i.e., Kd/Ka) and is expressed as a molar concentration (M). KD values for antibodies can be determined using methods in the art in view of the present disclosure. For example, the KD of an antibody can be determined by using surface plasmon resonance, such as by using a biosensor system, e.g., a Biacore® system, or by using bio-layer interferometry technology, such as an Octet® RED96 (interferometry instrument) system. The smaller the value of the KD of an antibody, the higher affinity that the antibody binds to a target antigen.

In one aspect, provided herein is an antibody that binds to CD8. In some embodiments, the CD8 antibody binds CD8α. In some embodiments, the CD8 antibody binds CD8β. In some embodiments, the CD8 antibody binds at the interface of CD8α and CD8β. In some embodiments, provided herein is an antibody that binds to a CD8 antigen. In some embodiments, the CD8 antibody binds CD8α antigen. In some embodiments, the CD8 antibody binds CD8β antigen. In some embodiments, the CD8 antibody binds an antigen on the interface of CD8α and CD8β. In some embodiments, provided herein is an antibody that binds to a CD8 epitope. In some embodiments, the CD8 antibody binds CD8α epitope. In some embodiments, the CD8 antibody binds CD8β epitope. In some embodiments, the CD8 antibody binds an epitope at the interface of CD8α and CD8β.

In some embodiments, the antibody comprises a heavy chain variable region and a light chain variable region. In a some embodiments, the CD8 antibody is not a single domain antibody or nanobody. In some embodiments, the CD8 antibody is a humanized antibody. In some embodiments, the CD8 antibody is a fully human antibody.

In certain embodiments, provided herein is a CD8 antibody comprising a VH region, VL region, VH CDR1, VH CDR2, VH CDR3, VL CDR1, VL CDR2, and/or VL CDR3 of any one of the antibodies described herein. In some embodiments, provided herein is a CD8 antibody comprising a VH region of any one of the antibodies described herein. In some embodiments, provided herein is a CD8 antibody comprising a VL region of any one of the antibodies described herein. In some embodiments, provided herein is a CD8 antibody comprising a VH region of any one of the antibodies described herein, and a VL region of any one of the antibodies described herein. In some embodiments, provided herein is a CD8 antibody comprising a VH CDR1, VH CDR2, and VH CDR3 of any one of the antibodies described herein. In some embodiments, provided herein is a CD8 antibody comprising a VL CDR1, VL CDR2, and VL CDR3 of any one of the antibodies described herein. In some embodiments, provided herein is a CD8 antibody comprising a VH CDR1, VH CDR2, and VH CDR3 of any one of the antibodies described herein; and a VL CDR1, VL CDR2, and VL CDR3 of any one of the antibodies described herein. Representative VH and VL amino acid sequences, including VH CDR1, VH CDR2, VH CDR3, VL CDR1, VL CDR2 and VL CDR3 amino acid sequences, of CD8 antibodies provided herein are provided in Tables 2-7.

In certain embodiments, provided herein is a CD8 multispecific antibody comprising a binding domain that binds to CD8 having a VH region, VL region, VH CDR1, VH CDR2, VH CDR3, VL CDR1, VL CDR2, and/or VL CDR3 of any one of the antibodies described herein. In some embodiments, provided herein is a CD8 multispecific antibody comprising a binding domain that binds to CD8 having a VH region of any one of the antibodies described herein. In some embodiments, provided herein is a CD8 multispecific antibody comprising a binding domain that binds to CD8 having a VL region of any one of the antibodies described herein. In some embodiments, provided herein is a CD8 multispecific antibody comprising a binding domain that binds to CD8 having a VH region of any one of the antibodies described herein, and a VL region of any one of the antibodies described herein. In some embodiments, provided herein is a CD8 multispecific antibody comprising a binding domain that binds to CD8 having a VH CDR1, VH CDR2, and VH CDR3 of any one of the antibodies described. In some embodiments, provided herein is a CD8 multispecific antibody comprising a binding domain that binds to CD8 having a VL CDR1, VL CDR2, and VL CDR3 of any one of the antibodies described herein. In some embodiments, provided herein is a CD8 multispecific antibody comprising a binding domain that binds to CD8 having a VH CDR1, VH CDR2, and VH CDR3 of any one of the antibodies described herein; and a VL CDR1, VL CDR2, and VL CDR3 of any one of the antibodies described herein. In certain embodiments, the CD8 antibody is a bispecific antibody. In certain embodiments, the CD8 antibody is a trispecific antibody. In certain embodiments, the CD8 antibody is a quadraspecific antibody.

In some embodiments, the antibody specifically binds CD8. In other embodiments, the CD8 is present on the surface of a T cell.

In some embodiments, the antibody is a humanized antibody. In certain embodiments, the antibody is an IgG antibody. In other embodiments, the IgG antibody is an IgG1, IgG2, IgG3, or IgG4 antibody. In some embodiments, the antibody is a bispecific antibody. In some embodiments, the antibody is a trispecific antibody. In some embodiments, the antibody is a quadraspecific antibody. In certain embodiments, the antibody is multivalent. In other embodiments, the antibody is capable of binding at least three antigens. In some embodiments, the antibody is capable of binding at least four antigens. In some embodiments, the antibody is capable of binding at least five antigens.

In certain embodiments, provided is a CD8 antibody that is an intact antibody. In other embodiments, provided is a CD8 antibody is an antigen binding fragment of the CD8 antibody. In some embodiments, the antigen binding fragment of the CD8 antibody is a functional fragment.

In some embodiments, the antigen binding fragment is a diabody. In some embodiments, the antigen binding fragment is a Fab. In some embodiments, the antigen binding fragment is a Fab'. In some embodiments, the antigen binding fragment is a F(ab')2. In some embodiments, the antigen binding fragment is a Fv fragment. In some embodiments, the antigen binding fragment is a disulfide stabilized Fv fragment (dsFv). In some embodiments, the antigen binding fragment is a $(dsFv)_2$. In some embodiments, the antigen binding fragment is a bispecific dsFv (dsFv-dsFv'). In some embodiments, the antigen binding fragment is a disulfide stabilized diabody (ds diabody). In some embodiments, the antigen binding fragment is a single-chain antibody molecule (scFv). In some embodiments, the antigen binding fragment is a single domain antibody (sdAb). In some embodiments, the antigen binding fragment is an scFv dimer (bivalent diabody). In some embodiments, the antigen binding fragment is a multispecific antibody formed from a portion of an antibody comprising one or more CDRs. In some embodiments, the antigen binding fragment is a camelized single domain antibody. In some embodiments, the antigen binding fragment is a nanobody. In some embodiments, the antigen binding fragment is a domain antibody. In some embodiments, the antigen binding fragment is a bivalent domain antibody. In some embodiments, the antigen binding fragment is an antibody fragment that binds to an antigen but does not comprise a complete antibody structure.

In specific embodiments, the CD8 antibody comprises a VH region and a VL region. In some embodiments, the CD8 antibody is a single chain antibody. In some embodiments, the CD8 antibody is a single domain antibody. In some embodiments, the CD8 antibody is a nanobody. In certain embodiments, the CD8 antibody is a VHH antibody. In certain embodiments, the CD8 antibody is a llama antibody. In some embodiments, the CD8 antibody is not a single chain antibody. In some embodiments, the CD8 antibody is not a single domain antibody. In some embodiments, the CD8 antibody is not a nanobody. In certain embodiments, the CD8 antibody is not a VHH antibody. In certain embodiments, the CD8 antibody is not a llama antibody. In some embodiments, the CD8 antibody is a multispecific antibody. In other embodiments, the CD8 antibody is a bispecific antibody. In other embodiments, the CD8 antibody is a trispecific antibody. In other embodiments, the CD8 antibody is a quadraspecific antibody. In certain embodiments, the multispecific antibody comprises an antigen binding fragment of a CD8 antibody provided herein. In other embodiments, the bispecific antibody comprises an antigen binding fragment of a CD8 antibody provided herein. In other embodiments, the trispecific antibody comprises an antigen binding fragment of a CD8 antibody provided herein. In other embodiments, the quadraspecific antibody comprises an antigen binding fragment of a CD8 antibody provided herein. In some embodiments, the CD8 antibody is an agonistic antibody. In certain embodiments, the CD8 antibody activates T cells. In other embodiments, the CD8 antibody is an antagonistic antibody. In certain embodiments, the CD8 antibody inactivates T cells. In some embodiments, the CD8 antibody blocks activation of T cells. In some embodiments, the CD8 antibody modulates the activity of T cells. In some embodiments, the CD8 antibody neither activates or inactivates the activity of T cells. In specific embodiments, the T cells are human T cells.

In some embodiments, the VH CDR1, VH CDR2, VH CDR3, VL CDR1, VL CDR2, and VL CDR3 sequences are according to the Kabat numbering system. In some embodiments, the VH CDR1, VH CDR2, VH CDR3, VL CDR1, VL CDR2, and VL CDR3 sequences are according to the Chothia numbering system. In some embodiments, the VH CDR1, VH CDR2, VH CDR3, VL CDR1, VL CDR2, and VL CDR3 sequences are according to the Exemplary numbering system. In some embodiments, the VH CDR1, VH CDR2, VH CDR3, VL CDR1, VL CDR2, and VL CDR3 sequences are according to the Contact numbering system. In some embodiments, the VH CDR1, VH CDR2, VH CDR3, VL CDR1, VL CDR2, and VL CDR3 sequences are according to the IMGT numbering system. In some embodiments, the VH CDR1, VH CDR2, VH CDR3, VL CDR1, VL CDR2, and VL CDR3 sequences are according to the AbM numbering system. Exemplary sets of 6 CDRs (VH CDR1-3 and VL CDR1-3) of certain antibody embodiments are provided herein. Other sets of CDRs are contemplated and within the scope of the antibody embodiments provided herein.

In one aspect, provided herein is an antibody that binds CD8. In one embodiment, provided is an antibody having a VH CDR1, VH CDR2 and a VH CDR3 of a CD8 antibody provided herein. In one embodiment, provided is an antibody having a VL CDR1, VL CDR2 and a VL CDR3 of a CD8 antibody provided herein. In one embodiment, provided is an antibody having a VH CDR1, VH CDR2, VH CDR3, VL CDR1, VL CDR2 and VL CDR3 of a CD8 antibody provided herein. In one embodiment, provided is an antibody having a VH of a CD8 antibody provided herein. In one embodiment, provided is an antibody having a VL of a CD8 antibody provided herein. In one embodiment, provided is an antibody having a VH and a VL of a CD8 antibody provided herein. In one embodiment, provided is an antibody having a heavy chain of a CD8 antibody provided herein. In one embodiment, provided is an antibody having a light chain of a CD8 antibody provided herein. In one embodiment, provided is an antibody having a heavy chain and a light chain of a CD8 antibody provided herein.

In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:31. In one embodiment, the CD8 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:32. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:31; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:32. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:65. In one embodiment, the CD8 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:66. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:65; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:66. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:99. In one embodiment, the CD8 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:100. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:99; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:100. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:133. In one embodiment, the CD8 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:134. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:133; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:134. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:167. In one embodiment, the CD8 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:168. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:167; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:168. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:201. In one embodiment, the CD8 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:202. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:201; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:202. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:235. In one embodiment, the CD8 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:236. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:235; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:236. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:269. In one embodiment, the CD8 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:270. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:269; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:270. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:303. In one embodiment, the CD8 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:304. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:303; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:304. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:337. In one embodiment, the CD8 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:338. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:337; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:338. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:371. In one embodiment, the CD8 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:372. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:371; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:372. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:405. In one embodiment, the CD8 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:406. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:405; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:406. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:439. In one embodiment, the CD8 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:440. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:439; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:440. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:473. In one embodiment, the CD8 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:474. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:473; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:474. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:507. In one embodiment, the CD8 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:508. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:507; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:508. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:541. In one embodiment, the CD8 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:542. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:541; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:542. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:575. In one embodiment, the CD8 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:576. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:575; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:576. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:609. In one embodiment, the CD8 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:610. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:609; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:610. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:643. In one embodiment, the CD8 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:644. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:643; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:644. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:677. In one embodiment, the CD8 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:678. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:677; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:678. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:711. In one embodiment, the CD8 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:712. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:711; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:712. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:745. In one embodiment, the CD8 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:746. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:745; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:746. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:779. In one embodiment, the CD8 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:780. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:779; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:780. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:813. In one embodiment, the CD8 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:814. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:813; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:814. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:847. In one embodiment, the CD8 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:848. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:847; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:848. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:881. In one embodiment, the CD8 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:882. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:881; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:882. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:915. In one embodiment, the CD8 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:916. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:915; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:916. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:949. In one embodiment, the CD8 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:950. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:949; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:950. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:983. In one embodiment, the CD8 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:984. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:983; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:984. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1017. In one embodiment, the CD8 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1018. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1017; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1018. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1051. In one embodiment, the CD8 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1052. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1051; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1052. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1085. In one embodiment, the CD8 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1086. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1085; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1086. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1119. In one embodiment, the CD8 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1120. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1119; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1120. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1153. In one embodiment, the CD8 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1154. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1153; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1154. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1187. In one embodiment, the CD8 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1188. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1187; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1188. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1221. In one embodiment, the CD8 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1222. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1221; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1222. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1255. In one embodiment, the CD8 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1256. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1255; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1256. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1289. In one embodiment, the CD8 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1290. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1289; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1290. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1323. In one embodiment, the CD8 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1324. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1323; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1324. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1357. In one embodiment, the CD8 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1358. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1357; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1358. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1391. In one embodiment, the CD8 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1392. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1391; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1392. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1425. In one embodiment, the CD8 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1426. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1425; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1426. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1459. In one embodiment, the CD8 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1460. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1459; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1460. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1493. In one embodiment, the CD8 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1494. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1493; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1494. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1527. In one embodiment, the CD8 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1528. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1527; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1528. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1561. In one embodiment, the CD8 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1562. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1561; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1562. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1595. In one embodiment, the CD8 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1596. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1595; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1596. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1629. In one embodiment, the CD8 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1630. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1629; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1630. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1663. In one embodiment, the CD8 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1664. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1663; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1664. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1697. In one embodiment, the CD8 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1698. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1697; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1698. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1731. In one embodiment, the CD8 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1732. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1731; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1732. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1765. In one embodiment, the CD8 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1766. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1765; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1766. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1799. In one embodiment, the CD8 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1800. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1799; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1800. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1833. In one embodiment, the CD8 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1834. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1833; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1834. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1867. In one embodiment, the CD8 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1868. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1867; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1868. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1901. In one embodiment, the CD8 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1902. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1901; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1902. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1935. In one embodiment, the CD8 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1936. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1935; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1936. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1969. In one embodiment, the CD8 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1970. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1969; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1970. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2003. In one embodiment, the CD8 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2004. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2003; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2004. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2037. In one embodiment, the CD8 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2038. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2037; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2038. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2071. In one embodiment, the CD8 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2072. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2071; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2072. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2105. In one embodiment, the CD8 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2106. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2105; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2106. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2139. In one embodiment, the CD8 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2140. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2139; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2140. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2173. In one embodiment, the CD8 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2174. In one embodiment, the CD8 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2173; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2174. In some embodiments, the CD8 antibody is a multispecific antibody. In some embodiments, the CD8 antibody is a bispecific antibody. In some embodiments, the CD8 antibody is a trispecific antibody. In some embodiments, the CD8 antibody is a quadraspecific antibody. In certain embodiments, the CD8 antibody is a multispecific antibody, wherein the second target is CD4. In certain embodiments, the CD8×CD4 multispecific antibody comprises a CD8 antibody provided herein and a CD4 antibody provided here.

In one aspect, provided herein is an antibody that binds CD8, comprising: (i) a VH comprising a VH CDR1, a VH CDR2, and a VH CDR3 having an amino acid sequence of SEQ ID NOs:1, 2, and 3, respectively, and (ii) a VL comprising a VL CDR1, VL CDR2, and VL CDR3 having an amino acid sequence of SEQ ID NOs:4, 5, and 6, respectively. In one aspect, provided herein is an antibody that binds CD8, comprising: (i) a VH comprising a VH CDR1, a VH CDR2, and a VH CDR3 having an amino acid sequence of SEQ ID NOs:7, 8, and 9, respectively, and (ii) a VL comprising a VL CDR1, VL CDR2, and VL CDR3 having an amino acid sequence of SEQ ID NOs:10, 11, and 12, respectively. In one aspect, provided herein is an antibody that binds CD8, comprising: (i) a VH comprising a VH CDR1, a VH CDR2, and a VH CDR3 having an amino acid sequence of SEQ ID NOs:13, 14, and 15, respectively, and (ii) a VL comprising a VL CDR1, VL CDR2, and VL CDR3 having an amino acid sequence of SEQ ID NOs:16, 17, and 18, respectively. In one aspect, provided herein is an antibody that binds CD8, comprising: (i) a VH comprising a VH CDR1, a VH CDR2, and a VH CDR3 having an amino acid sequence of SEQ ID NOs:19, 20, and 21, respectively, and (ii) a VL comprising a VL CDR1, VL CDR2, and VL CDR3 having an amino acid sequence of SEQ ID NOs:22, 23, and 24, respectively. In one aspect, provided herein is an antibody that binds CD8, comprising: (i) a VH comprising a VH CDR1, a VH CDR2, and a VH CDR3 having an amino acid sequence of SEQ ID NOs:25, 26, and 27, respectively, and (ii) a VL comprising a VL CDR1, VL CDR2, and VL CDR3 having an amino acid sequence of SEQ ID NOs:28, 29, and 30, respectively. In one aspect, provided herein is an antibody that binds CD8, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:31; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:32. In one aspect, provided herein is an antibody that binds CD8, comprising a VH having an amino acid sequence of SEQ ID NO:31. In one aspect, provided herein is an antibody that binds CD8, comprising a VL having an amino acid sequence of SEQ ID NO:32. In one aspect, provided herein is an antibody that binds CD8, comprising a VH having an amino acid sequence of SEQ ID NO:31, and a VL having an amino acid sequence of SEQ ID NO:32. In one aspect, provided herein is an antibody that binds CD8, comprising a heavy chain having an amino acid sequence of SEQ ID NO:33. In one aspect, provided herein is an antibody that binds CD8, comprising a light chain having an amino acid sequence of SEQ ID NO:34. In one aspect, provided herein is an antibody that binds CD8, comprising a heavy chain having an amino acid sequence of SEQ ID NO:33, and a light chain having an amino acid sequence of SEQ ID NO:34. In one aspect, provided herein is an antibody that binds CD8, comprising a VH having an amino acid sequence having at least 95% identity to an amino acid sequence of SEQ ID NO:31. In one aspect, provided herein is an antibody that binds CD8, comprising a VL having an amino acid sequence having at least 95% identity to an amino acid sequence of SEQ ID NO:32. In one aspect, provided herein is an antibody that binds CD8, comprising a VH having an amino acid sequence having at least 95% identity to an amino acid sequence of SEQ ID NO:31, and a VL having an amino acid sequence having at least 95% identity to an amino acid sequence of SEQ ID NO:32. In one aspect, provided herein is an antibody that binds CD8, comprising a heavy chain having an amino acid sequence having at least 95% identity to an amino acid sequence of SEQ ID NO:33. In one aspect, provided herein is an antibody that binds CD8, comprising a light chain having an amino acid sequence having at least 95% identity to an amino acid sequence of SEQ ID NO:34. In one aspect, provided herein is an antibody that binds CD8, comprising a heavy chain having an amino acid sequence having at least 95% identity to an amino acid sequence of SEQ ID NO:33, and a light chain having an amino acid sequence having at least 95% identity to an amino acid sequence of SEQ ID NO:34.

In one aspect, provided herein is an antibody that binds CD8, comprising: (i) a VH comprising a VH CDR1, a VH CDR2, and a VH CDR3 having an amino acid sequence of SEQ ID NOs:35, 36, and 37, respectively, and (ii) a VL comprising a VL CDR1, VL CDR2, and VL CDR3 having an amino acid sequence of SEQ ID NOs:38, 39, and 40, respectively. In one aspect, provided herein is an antibody that binds CD8, comprising: (i) a VH comprising a VH CDR1, a VH CDR2, and a VH CDR3 having an amino acid sequence of SEQ ID NOs:41, 42, and 43, respectively, and (ii) a VL comprising a VL CDR1, VL CDR2, and VL CDR3 having an amino acid sequence of SEQ ID NOs:44, 45, and 46, respectively. In one aspect, provided herein is an antibody that binds CD8, comprising: (i) a VH comprising a VH CDR1, a VH CDR2, and a VH CDR3 having an amino acid sequence of SEQ ID NOs:47, 48, and 49, respectively, and (ii) a VL comprising a VL CDR1, VL CDR2, and VL CDR3 having an amino acid sequence of SEQ ID NOs:50, 51, and 52, respectively. In one aspect, provided herein is an antibody that binds CD8, comprising: (i) a VH comprising a VH CDR1, a VH CDR2, and a VH CDR3 having an amino acid sequence of SEQ ID NOs:53, 54, and 55, respectively, and (ii) a VL comprising a VL CDR1, VL CDR2, and VL CDR3 having an amino acid sequence of SEQ ID NOs:56, 57, and 58, respectively. In one aspect, provided herein is an antibody that binds CD8, comprising: (i) a VH comprising a VH CDR1, a VH CDR2, and a VH CDR3 having an amino acid sequence of SEQ ID NOs:59, 60, and 61, respectively, and (ii) a VL comprising a VL CDR1, VL CDR2, and VL CDR3 having an amino acid sequence of SEQ ID NOs:62, 63, and 64, respectively. In one aspect, provided herein is an antibody that binds CD8, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:65; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:66. In one aspect, provided herein is an antibody that binds CD8, comprising a VH having an amino acid sequence of SEQ ID NO:65. In one aspect, provided herein is an antibody that binds CD8, comprising a VL having an amino acid sequence of SEQ ID NO:66. In one aspect, provided herein is an antibody that binds CD8, comprising a VH having an amino acid sequence of SEQ ID NO:65, and a VL having an amino acid sequence of SEQ ID NO:66. In one aspect, provided herein is an antibody that binds CD8, comprising a heavy chain having an amino acid sequence of SEQ ID NO:67. In one aspect, provided herein is an antibody that binds CD8, comprising a light chain having an amino acid sequence of SEQ ID NO:68. In one aspect, provided herein is an antibody that binds CD8, comprising a heavy chain having an amino acid sequence of SEQ ID NO:67, and a light chain having an amino acid sequence of SEQ ID NO:68. In one aspect, provided herein is an antibody that binds CD8, comprising a VH having an amino acid sequence having at least 95% identity to an amino acid sequence of SEQ ID NO:65. In one aspect, provided herein is an antibody that binds CD8, comprising a VL having an amino acid sequence having at least 95% identity to an amino acid sequence of SEQ ID NO:66. In one aspect, provided herein is an antibody that binds CD8, comprising a VH having an amino acid sequence having at least 95% identity to an amino acid sequence of SEQ ID NO:65, and a VL having an amino acid sequence having at least 95% identity to an amino acid sequence of SEQ ID NO:66. In one aspect, provided herein is an antibody that binds CD8, comprising a heavy chain having an amino acid sequence having at least 95% identity to an amino acid sequence of SEQ ID NO:67. In one aspect, provided herein is an antibody that binds CD8, comprising a light chain having an amino acid sequence having at least 95% identity to an amino acid sequence of SEQ ID NO:68. In one aspect, provided herein is an antibody that binds CD8, comprising a heavy chain having an amino acid sequence having at least 95% identity to an amino acid sequence of SEQ ID NO:67, and a light chain having an amino acid sequence having at least 95% identity to an amino acid sequence of SEQ ID NO:68.

In one aspect, provided herein is an antibody that binds CD8, comprising: (i) a VH comprising a VH CDR1, a VH CDR2, and a VH CDR3 having an amino acid sequence of SEQ ID NOs:69, 70, and 71, respectively, and (ii) a VL comprising a VL CDR1, VL CDR2, and VL CDR3 having an amino acid sequence of SEQ ID NOs:72, 73, and 74, respectively. In one aspect, provided herein is an antibody that binds CD8, comprising: (i) a VH comprising a VH CDR1, a VH CDR2, and a VH CDR3 having an amino acid sequence of SEQ ID NOs:75, 76, and 77, respectively, and (ii) a VL comprising a VL CDR1, VL CDR2, and VL CDR3 having an amino acid sequence of SEQ ID NOs:78, 79, and 80, respectively. In one aspect, provided herein is an antibody that binds CD8, comprising: (i) a VH comprising a VH CDR1, a VH CDR2, and a VH CDR3 having an amino acid sequence of SEQ ID NOs:81, 82, and 83, respectively, and (ii) a VL comprising a VL CDR1, VL CDR2, and VL CDR3 having an amino acid sequence of SEQ ID NOs:84, 85, and 86, respectively. In one aspect, provided herein is an antibody that binds CD8, comprising: (i) a VH comprising a VH CDR1, a VH CDR2, and a VH CDR3 having an amino acid sequence of SEQ ID NOs:87, 88, and 89, respectively, and (ii) a VL comprising a VL CDR1, VL CDR2, and VL CDR3 having an amino acid sequence of SEQ ID NOs:90, 91, and 92, respectively. In one aspect, provided herein is an antibody that binds CD8, comprising: (i) a VH comprising a VH CDR1, a VH CDR2, and a VH CDR3 having an amino acid sequence of SEQ ID NOs:93, 94, and 95, respectively, and (ii) a VL comprising a VL CDR1, VL CDR2, and VL CDR3 having an amino acid sequence of SEQ ID NOs:96, 97, and 98, respectively. In one aspect, provided herein is an antibody that binds CD8, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:99; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:100. In one aspect, provided herein is an antibody that binds CD8, comprising a VH having an amino acid sequence of SEQ ID NO:99. In one aspect, provided herein is an antibody that binds CD8, comprising a VL having an amino acid sequence of SEQ ID NO:100. In one aspect, provided herein is an antibody that binds CD8, comprising a VH having an amino acid sequence of SEQ ID NO:99, and a VL having an amino acid sequence of SEQ ID NO:100. In one aspect, provided herein is an antibody that binds CD8, comprising a heavy chain having an amino acid sequence of SEQ ID NO:101. In one aspect, provided herein is an antibody that binds CD8, comprising a light chain having an amino acid sequence of SEQ ID NO:102. In one aspect, provided herein is an antibody that binds CD8, comprising a heavy chain having an amino acid sequence of SEQ ID NO:101, and a light chain having an amino acid sequence of SEQ ID NO:102. In one aspect, provided herein is an antibody that binds CD8, comprising a VH having an amino acid sequence having at least 95% identity to an amino acid sequence of SEQ ID NO:99. In one aspect, provided herein is an antibody that binds CD8, comprising a VL having an amino acid sequence having at least 95% identity to an amino acid sequence of SEQ ID NO:100. In one aspect, provided herein is an antibody that binds CD8, comprising a VH having an amino acid sequence having at least 95% identity to an amino acid sequence of SEQ ID NO:99, and a VL having an amino acid sequence having at least 95% identity to an amino acid sequence of SEQ ID NO:100. In one aspect, provided herein is an antibody that binds CD8, comprising a heavy chain having an amino acid sequence having at least 95% identity to an amino acid sequence of SEQ ID NO:101. In one aspect, provided herein is an antibody that binds CD8, comprising a light chain having an amino acid sequence having at least 95% identity to an amino acid sequence of SEQ ID NO:102. In one aspect, provided herein is an antibody that binds CD8, comprising a heavy chain having an amino acid sequence having at least 95% identity to an amino acid sequence of SEQ ID NO:101, and a light chain having an amino acid sequence having at least 95% identity to an amino acid sequence of SEQ ID NO:102.

In one aspect, provided herein is an antibody that binds CD8, comprising: (i) a VH comprising a VH CDR1, a VH CDR2, and a VH CDR3 having an amino acid sequence of SEQ ID NOs:103, 104, and 105, respectively, and (ii) a VL comprising a VL CDR1, VL CDR2, and VL CDR3 having an amino acid sequence of SEQ ID NOs:106, 107, and 108, respectively. In one aspect, provided herein is an antibody that binds CD8, comprising: (i) a VH comprising a VH CDR1, a VH CDR2, and a VH CDR3 having an amino acid sequence of SEQ ID NOs:109, 110, and 111, respectively, and (ii) a VL comprising a VL CDR1, a VL CDR2, and VL CDR3 having an amino acid sequence of SEQ ID NOs:112, 113, and 114, respectively. In one aspect, provided herein is an antibody that binds CD8, comprising: (i) a VH comprising a VH CDR1, a VH CDR2, and a VH CDR3 having an amino acid sequence of SEQ ID NOs:115, 116, and 117, respectively, and (ii) a VL comprising a VL CDR1, VL CDR2, and VL CDR3 having an amino acid sequence of SEQ ID NOs:118, 119, and 120, respectively. In one aspect, provided herein is an antibody that binds CD8, comprising: (i) a VH comprising a VH CDR1, a VH CDR2, and a VH CDR3 having an amino acid sequence of SEQ ID NOs:121, 122, and 123, respectively, and (ii) a VL comprising a VL CDR1, VL CDR2, and VL CDR3 having an amino acid sequence of SEQ ID NOs:124, 125, and 126, respectively. In one aspect, provided herein is an antibody that binds CD8, comprising: (i) a VH comprising a VH CDR1, a VH CDR2, and a VH CDR3 having an amino acid sequence of SEQ ID NOs:127, 128, and 129, respectively, and (ii) a VL comprising a VL CDR1, VL CDR2, and VL CDR3 having an amino acid sequence of SEQ ID NOs:130, 131, and 132, respectively. In one aspect, provided herein is an antibody that binds CD8, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:133; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:134. In one aspect, provided herein is an antibody that binds CD8, comprising a VH having an amino acid sequence of SEQ ID NO:133. In one aspect, provided herein is an antibody that binds CD8, comprising a VL having an amino acid sequence of SEQ ID NO:134. In one aspect, provided herein is an antibody that binds CD8, comprising a VH having an amino acid sequence of SEQ ID NO:133, and a VL having an amino acid sequence of SEQ ID NO:134. In one aspect, provided herein is an antibody that binds CD8, comprising a heavy chain having an amino acid sequence of SEQ ID NO:135. In one aspect, provided herein is an antibody that binds CD8, comprising a light chain having an amino acid sequence of SEQ ID NO:136. In one aspect, provided herein is an antibody that binds CD8, comprising a heavy chain having an amino acid sequence of SEQ ID NO:135, and a light chain having an amino acid sequence of SEQ ID NO:136. In one aspect, provided herein is an antibody that binds CD8, comprising a VH having an amino acid sequence having at least 95% identity to an amino acid sequence of SEQ ID NO:133. In one aspect, provided herein is an antibody that binds CD8, comprising a VL having an amino acid sequence having at least 95% identity to an amino acid sequence of SEQ ID NO:134. In one aspect, provided herein is an antibody that binds CD8, comprising a VH having an amino acid sequence having at least 95% identity to an amino acid sequence of SEQ ID NO:133, and a VL having an amino acid sequence having at least 95% identity to an amino acid sequence of SEQ ID NO:134. In one aspect, provided herein is an antibody that binds CD8, comprising a heavy chain having an amino acid sequence having at least 95% identity to an amino acid sequence of SEQ ID NO:135. In one aspect, provided herein is an antibody that binds CD8, comprising a light chain having an amino acid sequence having at least 95% identity to an amino acid sequence of SEQ ID NO:136. In one aspect, provided herein is an antibody that binds CD8, comprising a heavy chain having an amino acid sequence having at least 95% identity to an amino acid sequence of SEQ ID NO:135, and a light chain having an amino acid sequence having at least 95% identity to an amino acid sequence of SEQ ID NO:136.

In one aspect, provided herein is an antibody that binds CD8, comprising: (i) a VH comprising a VH CDR1, a VH CDR2, and a VH CDR3 having an amino acid sequence of SEQ ID NOs:137, 138, and 139, respectively, and (ii) a VL comprising a VL CDR1, VL CDR2, and VL CDR3 having an amino acid sequence of SEQ ID NOs:140, 141, and 142, respectively. In one aspect, provided herein is an antibody that binds CD8, comprising: (i) a VH comprising a VH CDR1, a VH CDR2, and a VH CDR3 having an amino acid sequence of SEQ ID NOs:143, 144, and 145, respectively, and (ii) a VL comprising a VL CDR1, VL CDR2, and VL CDR3 having an amino acid sequence of SEQ ID NOs:146, 147, and 148, respectively. In one aspect, provided herein is an antibody that binds CD8, comprising: (i) a VH comprising a VH CDR1, a VH CDR2, and a VH CDR3 having an amino acid sequence of SEQ ID NOs:149, 150, and 151, respectively, and (ii) a VL comprising a VL CDR1, VL CDR2, and VL CDR3 having an amino acid sequence of SEQ ID NOs:152, 153, and 154, respectively. In one aspect, provided herein is an antibody that binds CD8, comprising: (i) a VH comprising a VH CDR1, a VH CDR2, and a VH CDR3 having an amino acid sequence of SEQ ID NOs:155, 156, and 157, respectively, and (ii) a VL comprising a VL CDR1, VL CDR2, and VL CDR3 having an amino acid sequence of SEQ ID NOs:158, 159, and 160, respectively. In one aspect, provided herein is an antibody that binds CD8, comprising: (i) a VH comprising a VH CDR1, a VH CDR2, and a VH CDR3 having an amino acid sequence of SEQ ID NOs:161, 162, and 163, respectively, and (ii) a VL comprising a VL CDR1, VL CDR2, and VL CDR3 having an amino acid sequence of SEQ ID NOs:164, 165, and 166, respectively. In one aspect, provided herein is an antibody that binds CD8, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:167; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:168. In one aspect, provided herein is an antibody that binds CD8, comprising a VH having an amino acid sequence of SEQ ID NO:167. In one aspect, provided herein is an antibody that binds CD8, comprising a VL having an amino acid sequence of SEQ ID NO:168. In one aspect, provided herein is an antibody that binds CD8, comprising a VH having an amino acid sequence of SEQ ID NO:167, and a VL having an amino acid sequence of SEQ ID NO:168. In one aspect, provided herein is an antibody that binds CD8, comprising a heavy chain having an amino acid sequence of SEQ ID NO:169. In one aspect, provided herein is an antibody that binds CD8, comprising a light chain having an amino acid sequence of SEQ ID NO:170. In one aspect, provided herein is an antibody that binds CD8, comprising a heavy chain having an amino acid sequence of SEQ ID NO:169, and a light chain having an amino acid sequence of SEQ ID NO:170. In one aspect, provided herein is an antibody that binds CD8, comprising a VH having an amino acid sequence having at least 95% identity to an amino acid sequence of SEQ ID NO:167. In one aspect, provided herein is an antibody that binds CD8, comprising a VL having an amino acid sequence having at least 95% identity to an amino acid sequence of SEQ ID NO:168. In one aspect, provided herein is an antibody that binds CD8, comprising a VH having an amino acid sequence having at least 95% identity to an amino acid sequence of SEQ ID NO:167, and a VL having an amino acid sequence having at least 95% identity to an amino acid sequence of SEQ ID NO:168. In one aspect, provided herein is an antibody that binds CD8, comprising a heavy chain having an amino acid sequence having at least 95% identity to an amino acid sequence of SEQ ID NO:169. In one aspect, provided herein is an antibody that binds CD8, comprising a light chain having an amino acid sequence having at least 95% identity to an amino acid sequence of SEQ ID NO:170. In one aspect, provided herein is an antibody that binds CD8, comprising a heavy chain having an amino acid sequence having at least 95% identity to an amino acid sequence of SEQ ID NO:169, and a light chain having an amino acid sequence having at least 95% identity to an amino acid sequence of SEQ ID NO:170.

In one aspect, provided herein is an antibody that binds CD8, comprising: (i) a VH comprising a VH CDR1, a VH CDR2, and a VH CDR3 having an amino acid sequence of SEQ ID NOs:171, 172, and 173, respectively, and (ii) a VL comprising a VL CDR1, VL CDR2, and VL CDR3 having an amino acid sequence of SEQ ID NOs:174, 175, and 176, respectively. In one aspect, provided herein is an antibody that binds CD8, comprising: (i) a VH comprising a VH CDR1, a VH CDR2, and a VH CDR3 having an amino acid sequence of SEQ ID NOs:177, 178, and 179, respectively, and (ii) a VL comprising a VL CDR1, VL CDR2, and VL CDR3 having an amino acid sequence of SEQ ID NOs:180, 181, and 182, respectively. In one aspect, provided herein is an antibody that binds CD8, comprising: (i) a VH comprising a VH CDR1, a VH CDR2, and a VH CDR3 having an amino acid sequence of SEQ ID NOs:183, 184, and 185, respectively, and (ii) a VL comprising a VL CDR1, VL CDR2, and VL CDR3 having an amino acid sequence of SEQ ID NOs:186, 187, and 188, respectively. In one aspect, provided herein is an antibody that binds CD8, comprising: (i) a VH comprising a VH CDR1, a VH CDR2, and a VH CDR3 having an amino acid sequence of SEQ ID NOs:189, 190, and 191, respectively, and (ii) a VL comprising a VL CDR1, VL CDR2, and VL CDR3 having an amino acid sequence of SEQ ID NOs:192, 193, and 194, respectively. In one aspect, provided herein is an antibody that binds CD8, comprising: (i) a VH comprising a VH CDR1, a VH CDR2, and a VH CDR3 having an amino acid sequence of SEQ ID NOs:195, 196, and 197, respectively, and (ii) a VL comprising a VL CDR1, VL CDR2, and VL CDR3 having an amino acid sequence of SEQ ID NOs:198, 199, and 200, respectively. In one aspect, provided herein is an antibody that binds CD8, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:201; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:202. In one aspect, provided herein is an antibody that binds CD8, comprising a VH having an amino acid sequence of SEQ ID NO:201. In one aspect, provided herein is an antibody that binds CD8, comprising a VL having an amino acid sequence of SEQ ID NO:202. In one aspect, provided herein is an antibody that binds CD8, comprising a VH having an amino acid sequence of SEQ ID NO:201, and a VL having an amino acid sequence of SEQ ID NO:202. In one aspect, provided herein is an antibody that binds CD8, comprising a heavy chain having an amino acid sequence of SEQ ID NO:203. In one aspect, provided herein is an antibody that binds CD8, comprising a light chain having an amino acid sequence of SEQ ID NO:204. In one aspect, provided herein is an antibody that binds CD8, comprising a heavy chain having an amino acid sequence of SEQ ID NO:203, and a light chain having an amino acid sequence of SEQ ID NO:204. In one aspect, provided herein is an antibody that binds CD8, comprising a VH having an amino acid sequence having at least 95% identity to an amino acid sequence of SEQ ID NO:201. In one aspect, provided herein is an antibody that binds CD8, comprising a VL having an amino acid sequence having at least 95% identity to an amino acid sequence of SEQ ID NO:202. In one aspect, provided herein is an antibody that binds CD8, comprising a VH having an amino acid sequence having at least 95% identity to an amino acid sequence of SEQ ID NO:201, and a VL having an amino acid sequence having at least 95% identity to an amino acid sequence of SEQ ID NO:202. In one aspect, provided herein is an antibody that binds CD8, comprising a heavy chain having an amino acid sequence having at least 95% identity to an amino acid sequence of SEQ ID NO:203. In one aspect, provided herein is an antibody that binds CD8, comprising a light chain having an amino acid sequence having at least 95% identity to an amino acid sequence of SEQ ID NO:204. In one aspect, provided herein is an antibody that binds CD8, comprising a heavy chain having an amino acid sequence having at least 95% identity to an amino acid sequence of SEQ ID NO:203, and a light chain having an amino acid sequence having at least 95% identity to an amino acid sequence of SEQ ID NO:204.

In one aspect, provided herein is an antibody that binds CD8, comprising: (i) a VH comprising a VH CDR1, a VH CDR2, and a VH CDR3 having an amino acid sequence of SEQ ID NOs:205, 206, and 207, respectively, and (ii) a VL comprising a VL CDR1, VL CDR2, and VL CDR3 having an amino acid sequence of SEQ ID NOs:208, 209, and 210, respectively. In one aspect, provided herein is an antibody that binds CD8, comprising: (i) a VH comprising a VH CDR1, a VH CDR2, and a VH CDR3 having an amino acid sequence of SEQ ID NOs:211, 212, and 213, respectively, and (ii) a VL comprising a VL CDR1, VL CDR2, and VL CDR3 having an amino acid sequence of SEQ ID NOs:214, 215, and 216, respectively. In one aspect, provided herein is an antibody that binds CD8, comprising: (i) a VH comprising a VH CDR1, a VH CDR2, and a VH CDR3 having an amino acid sequence of SEQ ID NOs:217, 218, and 219, respectively, and (ii) a VL comprising a VL CDR1, VL CDR2, and VL CDR3 having an amino acid sequence of SEQ ID NOs:220, 221, and 222, respectively. In one aspect, provided herein is an antibody that binds CD8, comprising: (i) a VH comprising a VH CDR1, a VH CDR2, and a VH CDR3 having an amino acid sequence of SEQ ID NOs:223, 224, and 225, respectively, and (ii) a VL comprising a VL CDR1, VL CDR2, and VL CDR3 having an amino acid sequence of SEQ ID NOs:226, 227, and 228, respectively. In one aspect, provided herein is an antibody that binds CD8, comprising: (i) a VH comprising a VH CDR1, a VH CDR2, and a VH CDR3 having an amino acid sequence of SEQ ID NOs:229, 230, and 231, respectively, and (ii) a VL comprising a VL CDR1, VL CDR2, and VL CDR3 having an amino acid sequence of SEQ ID NOs:232, 233, and 234, respectively. In one aspect, provided herein is an antibody that binds CD8, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:235; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:236. In one aspect, provided herein is an antibody that binds CD8, comprising a VH having an amino acid sequence of SEQ ID NO:235. In one aspect, provided herein is an antibody that binds CD8, comprising a VL having an amino acid sequence of SEQ ID NO:236. In one aspect, provided herein is an antibody that binds CD8, comprising a VH having an amino acid sequence of SEQ ID NO:235, and a VL having an amino acid sequence of SEQ ID NO:236. In one aspect, provided herein is an antibody that binds CD8, comprising a heavy chain having an amino acid sequence of SEQ ID NO:237. In one aspect, provided herein is an antibody that binds CD8, comprising a light chain having an amino acid sequence of SEQ ID NO:238. In one aspect, provided herein is an antibody that binds CD8, comprising a heavy chain having an amino acid sequence of SEQ ID NO:237, and a light chain having an amino acid sequence of SEQ ID NO:238. In one aspect, provided herein is an antibody that binds CD8, comprising a VH having an amino acid sequence having at least 95% identity to an amino acid sequence of SEQ ID NO:235. In one aspect, provided herein is an antibody that binds CD8, comprising a VL having an amino acid sequence having at least 95% identity to an amino acid sequence of SEQ ID NO:236. In one aspect, provided herein is an antibody that binds CD8, comprising a VH having an amino acid sequence having at least 95% identity to an amino acid sequence of SEQ ID NO:235, and a VL having an amino acid sequence having at least 95% identity to an amino acid sequence of SEQ ID NO:236. In one aspect, provided herein is an antibody that binds CD8, comprising a heavy chain having an amino acid sequence having at least 95% identity to an amino acid sequence of SEQ ID NO:237. In one aspect, provided herein is an antibody that binds CD8, comprising a light chain having an amino acid sequence having at least 95% identity to an amino acid sequence of SEQ ID NO:238. In one aspect, provided herein is an antibody that binds CD8, comprising a heavy chain having an amino acid sequence having at least 95% identity to an amino acid sequence of SEQ ID NO:237, and a light chain having an amino acid sequence having at least 95% identity to an amino acid sequence of SEQ ID NO:238.

In one aspect, provided herein is an antibody that binds CD8, comprising: (i) a VH comprising a VH CDR1, a VH CDR2, and a VH CDR3 having an amino acid sequence of SEQ ID NOs:239, 240, and 241, respectively, and (ii) a VL comprising a VL CDR1, VL CDR2, and VL CDR3 having an amino acid sequence of SEQ ID NOs:242, 243, and 244, respectively. In one aspect, provided herein is an antibody that binds CD8, comprising: (i) a VH comprising a VH CDR1, a VH CDR2, and a VH CDR3 having an amino acid sequence of SEQ ID NOs:245, 246, and 247, respectively, and (ii) a VL comprising a VL CDR1, VL CDR2, and VL CDR3 having an amino acid sequence of SEQ ID NOs:248, 249, and 250, respectively. In one aspect, provided herein is an antibody that binds CD8, comprising: (i) a VH comprising a VH CDR1, a VH CDR2, and a VH CDR3 having an amino acid sequence of SEQ ID NOs:251, 252, and 253, respectively, and (ii) a VL comprising a VL CDR1, VL CDR2, and VL CDR3 having an amino acid sequence of SEQ ID NOs:254, 255, and 256, respectively. In one aspect, provided herein is an antibody that binds CD8, comprising: (i) a VH comprising a VH CDR1, a VH CDR2, and a VH CDR3 having an amino acid sequence of SEQ ID NOs:257, 258, and 259, respectively, and (ii) a VL comprising a VL CDR1, VL CDR2, and VL CDR3 having an amino acid sequence of SEQ ID NOs:260, 261, and 262, respectively. In one aspect, provided herein is an antibody that binds CD8, comprising: (i) a VH comprising a VH CDR1, a VH CDR2, and a VH CDR3 having an amino acid sequence of SEQ ID NOs:263, 264, and 265, respectively, and (ii) a VL comprising a VL CDR1, VL CDR2, and VL CDR3 having an amino acid sequence of SEQ ID NOs:266, 267, and 268, respectively. In one aspect, provided herein is an antibody that binds CD8, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:269; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:270. In one aspect, provided herein is an antibody that binds CD8, comprising a VH having an amino acid sequence of SEQ ID NO:269. In one aspect, provided herein is an antibody that binds CD8, comprising a VL having an amino acid sequence of SEQ ID NO:270. In one aspect, provided herein is an antibody that binds CD8, comprising a VH having an amino acid sequence of SEQ ID NO:269, and a VL having an amino acid sequence of SEQ ID NO:270. In one aspect, provided herein is an antibody that binds CD8, comprising a heavy chain having an amino acid sequence of SEQ ID NO:271. In one aspect, provided herein is an antibody that binds CD8, comprising a light chain having an amino acid sequence of SEQ ID NO:272. In one aspect, provided herein is an antibody that binds CD8, comprising a heavy chain having an amino acid sequence of SEQ ID NO:271, and a light chain having an amino acid sequence of SEQ ID NO:272. In one aspect, provided herein is an antibody that binds CD8, comprising a VH having an amino acid sequence having at least 95% identity to an amino acid sequence of SEQ ID NO:269. In one aspect, provided herein is an antibody that binds CD8, comprising a VL having an amino acid sequence having at least 95% identity to an amino acid sequence of SEQ ID NO:270. In one aspect, provided herein is an antibody that binds CD8, comprising a VH having an amino acid sequence having at least 95% identity to an amino acid sequence of SEQ ID NO:269, and a VL having an amino acid sequence having at least 95% identity to an amino acid sequence of SEQ ID NO:270. In one aspect, provided herein is an antibody that binds CD8, comprising a heavy chain having an amino acid sequence having at least 95% identity to an amino acid sequence of SEQ ID NO:271. In one aspect, provided herein is an antibody that binds CD8, comprising a light chain having an amino acid sequence having at least 95% identity to an amino acid sequence of SEQ ID NO:272. In one aspect, provided herein is an antibody that binds CD8, comprising a heavy chain having an amino acid sequence having at least 95% identity to an amino acid sequence of SEQ ID NO:271, and a light chain having an amino acid sequence having at least 95% identity to an amino acid sequence of SEQ ID NO:272.

In one aspect, provided herein is an antibody that binds CD8, comprising: (i) a VH comprising a VH CDR1, a VH CDR2, and a VH CDR3 having an amino acid sequence of SEQ ID NOs:273, 274, and 275, respectively, and (ii) a VL comprising a VL CDR1, VL CDR2, and VL CDR3 having an amino acid sequence of SEQ ID NOs:276, 277, and 278, respectively. In one aspect, provided herein is an antibody that binds CD8, comprising: (i) a VH comprising a VH CDR1, a VH CDR2, and a VH CDR3 having an amino acid sequence of SEQ ID NOs:279, 280, and 281, respectively, and (ii) a VL comprising a VL CDR1, VL CDR2, and VL CDR3 having an amino acid sequence of SEQ ID NOs:282, 283, and 284, respectively. In one aspect, provided herein is an antibody that binds CD8, comprising: (i) a VH comprising a VH CDR1, a VH CDR2, and a VH CDR3 having an amino acid sequence of SEQ ID NOs:285, 286, and 287, respectively, and (ii) a VL comprising a VL CDR1, VL CDR2, and VL CDR3 having an amino acid sequence of SEQ ID NOs:288, 289, and 290, respectively. In one aspect, provided herein is an antibody that binds CD8, comprising: (i) a VH comprising a VH CDR1, a VH CDR2, and a VH CDR3 having an amino acid sequence of SEQ ID NOs:291, 292, and 293, respectively, and (ii) a VL comprising a VL CDR1, VL CDR2, and VL CDR3 having an amino acid sequence of SEQ ID NOs:294, 295, and 296, respectively. In one aspect, provided herein is an antibody that binds CD8, comprising: (i) a VH comprising a VH CDR1, a VH CDR2, and a VH CDR3 having an amino acid sequence of SEQ ID NOs:297, 298, and 299, respectively, and (ii) a VL comprising a VL CDR1, VL CDR2, and VL CDR3 having an amino acid sequence of SEQ ID NOs:300, 301, and 302, respectively. In one aspect, provided herein is an antibody that binds CD8, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:303; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:304. In one aspect, provided herein is an antibody that binds CD8, comprising a VH having an amino acid sequence of SEQ ID NO:303. In one aspect, provided herein is an antibody that binds CD8, comprising a VL having an amino acid sequence of SEQ ID NO:304. In one aspect, provided herein is an antibody that binds CD8, comprising a VH having an amino acid sequence of SEQ ID NO:303, and a VL having an amino acid sequence of SEQ ID NO:304. In one aspect, provided herein is an antibody that binds CD8, comprising a heavy chain having an amino acid sequence of SEQ ID NO:305. In one aspect, provided herein is an antibody that binds CD8, comprising a light chain having an amino acid sequence of SEQ ID NO:306. In one aspect, provided herein is an antibody that binds CD8, comprising a heavy chain having an amino acid sequence of SEQ ID NO:305, and a light chain having an amino acid sequence of SEQ ID NO:306. In one aspect, provided herein is an antibody that binds CD8, comprising a VH having an amino acid sequence having at least 95% identity to an amino acid sequence of SEQ ID NO:303. In one aspect, provided herein is an antibody that binds CD8, comprising a VL having an amino acid sequence having at least 95% identity to an amino acid sequence of SEQ ID NO:304. In one aspect, provided herein is an antibody that binds CD8, comprising a VH having an amino acid sequence having at least 95% identity to an amino acid sequence of SEQ ID NO:303, and a VL having an amino acid sequence having at least 95% identity to an amino acid sequence of SEQ ID NO:304. In one aspect, provided herein is an antibody that binds CD8, comprising a heavy chain having an amino acid sequence having at least 95% identity to an amino acid sequence of SEQ ID NO:305. In one aspect, provided herein is an antibody that binds CD8, comprising a light chain having an amino acid sequence having at least 95% identity to an amino acid sequence of SEQ ID NO:306. In one aspect, provided herein is an antibody that binds CD8, comprising a heavy chain having an amino acid sequence having at least 95% identity to an amino acid sequence of SEQ ID NO:305, and a light chain having an amino acid sequence having at least 95% identity to an amino acid sequence of SEQ ID NO:306.

In one aspect, provided herein is an antibody that binds CD8, comprising: (i) a VH comprising a VH CDR1, a VH CDR2, and a VH CDR3 having an amino acid sequence of SEQ ID NOs:307, 308, and 309, respectively, and (ii) a VL comprising a VL CDR1, VL CDR2, and VL CDR3 having an amino acid sequence of SEQ ID NOs:310, 311, and 312, respectively. In one aspect, provided herein is an antibody that binds CD8, comprising: (i) a VH comprising a VH CDR1, a VH CDR2, and a VH CDR3 having an amino acid sequence of SEQ ID NOs:313, 314, and 315, respectively, and (ii) a VL comprising a VL CDR1, VL CDR2, and VL CDR3 having an amino acid sequence of SEQ ID NOs:316, 317, and 318, respectively. In one aspect, provided herein is an antibody that binds CD8, comprising: (i) a VH comprising a VH CDR1, a VH CDR2, and a VH CDR3 having an amino acid sequence of SEQ ID NOs:319, 320, and 321, respectively, and (ii) a VL comprising a VL CDR1, VL CDR2, and VL CDR3 having an amino acid sequence of SEQ ID NOs:322, 323, and 324, respectively. In one aspect, provided herein is an antibody that binds CD8, comprising: (i) a VH comprising a VH CDR1, a VH CDR2, and a VH CDR3 having an amino acid sequence of SEQ ID NOs:325, 326, and 327, respectively, and (ii) a VL comprising a VL CDR1, VL CDR2, and VL CDR3 having an amino acid sequence of SEQ ID NOs:328, 329, and 330, respectively. In one aspect, provided herein is an antibody that binds CD8, comprising: (i) a VH comprising a VH CDR1, a VH CDR2, and a VH CDR3 having an amino acid sequence of SEQ ID NOs:331, 332, and 333, respectively, and (ii) a VL comprising a VL CDR1, VL CDR2, and VL CDR3 having an amino acid sequence of SEQ ID NOs:334, 335, and 336, respectively. In one aspect, provided herein is an antibody that binds CD8, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:337; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:338. In one aspect, provided herein is an antibody that binds CD8, comprising a VH having an amino acid sequence of SEQ ID NO:337. In one aspect, provided herein is an antibody that binds CD8, comprising a VL having an amino acid sequence of SEQ ID NO:338. In one aspect, provided herein is an antibody that binds CD8, comprising a VH having an amino acid sequence of SEQ ID NO:337, and a VL having an amino acid sequence of SEQ ID NO:338. In one aspect, provided herein is an antibody that binds CD8, comprising a heavy chain having an amino acid sequence of SEQ ID NO:339. In one aspect, provided herein is an antibody that binds CD8, comprising a light chain having an amino acid sequence of SEQ ID NO:340. In one aspect, provided herein is an antibody that binds CD8, comprising a heavy chain having an amino acid sequence of SEQ ID NO:339, and a light chain having an amino acid sequence of SEQ ID NO:340. In one aspect, provided herein is an antibody that binds CD8, comprising a VH having an amino acid sequence having at least 95% identity to an amino acid sequence of SEQ ID NO:337. In one aspect, provided herein is an antibody that binds CD8, comprising a VL having an amino acid sequence having at least 95% identity to an amino acid sequence of SEQ ID NO:338. In one aspect, provided herein is an antibody that binds CD8, comprising a VH having an amino acid sequence having at least 95% identity to an amino acid sequence of SEQ ID NO:337, and a VL having an amino acid sequence having at least 95% identity to an amino acid sequence of SEQ ID NO:338. In one aspect, provided herein is an antibody that binds CD8, comprising a heavy chain having an amino acid sequence having at least 95% identity to an amino acid sequence of SEQ ID NO:339. In one aspect, provided herein is an antibody that binds CD8, comprising a light chain having an amino acid sequence having at least 95% identity to an amino acid sequence of SEQ ID NO:340. In one aspect, provided herein is an antibody that binds CD8, comprising a heavy chain having an amino acid sequence having at least 95% identity to an amino acid sequence of SEQ ID NO:339, and a light chain having an amino acid sequence having at least 95% identity to an amino acid sequence of SEQ ID NO:340.

In one aspect, provided herein is an antibody that binds CD8, comprising: (i) a VH comprising a VH CDR1, a VH CDR2, and a VH CDR3 having an amino acid sequence of SEQ ID NOs:341, 342, and 343, respectively, and (ii) a VL comprising a VL CDR1, VL CDR2, and VL CDR3 having an amino acid sequence of SEQ ID NOs:344, 345, and 346, respectively. In one aspect, provided herein is an antibody that binds CD8, comprising: (i) a VH comprising a VH CDR1, a VH CDR2, and a VH CDR3 having an amino acid sequence of SEQ ID NOs:347, 348, and 349, respectively, and (ii) a VL comprising a VL CDR1, VL CDR2, and VL CDR3 having an amino acid sequence of SEQ ID NOs:350, 351, and 352, respectively. In one aspect, provided herein is an antibody that binds CD8, comprising: (i) a VH comprising a VH CDR1, a VH CDR2, and a VH CDR3 having an amino acid sequence of SEQ ID NOs:353, 354, and 355, respectively, and (ii) a VL comprising a VL CDR1, VL CDR2, and VL CDR3 having an amino acid sequence of SEQ ID NOs:356, 357, and 358, respectively. In one aspect, provided herein is an antibody that binds CD8, comprising: (i) a VH comprising a VH CDR1, a VH CDR2, and a VH CDR3 having an amino acid sequence of SEQ ID NOs:359, 360, and 361, respectively, and (ii) a VL comprising a VL CDR1, VL CDR2, and VL CDR3 having an amino acid sequence of SEQ ID NOs:362, 363, and 364, respectively. In one aspect, provided herein is an antibody that binds CD8, comprising: (i) a VH comprising a VH CDR1, a VH CDR2, and a VH CDR3 having an amino acid sequence of SEQ ID NOs:365, 366, and 367, respectively, and (ii) a VL comprising a VL CDR1, VL CDR2, and VL CDR3 having an amino acid sequence of SEQ ID NOs:368, 369, and 370, respectively. In one aspect, provided herein is an antibody that binds CD8, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:371; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:372. In one aspect, provided herein is an antibody that binds CD8, comprising a VH having an amino acid sequence of SEQ ID NO:371. In one aspect, provided herein is an antibody that binds CD8, comprising a VL having an amino acid sequence of SEQ ID NO:372. In one aspect, provided herein is an antibody that binds CD8, comprising a VH having an amino acid sequence of SEQ ID NO:371, and a VL having an amino acid sequence of SEQ ID NO:372. In one aspect, provided herein is an antibody that binds CD8, comprising a heavy chain having an amino acid sequence of SEQ ID NO:373. In one aspect, provided herein is an antibody that binds CD8, comprising a light chain having an amino acid sequence of SEQ ID NO:374. In one aspect, provided herein is an antibody that binds CD8, comprising a heavy chain having an amino acid sequence of SEQ ID NO:373, and a light chain having an amino acid sequence of SEQ ID NO:374. In one aspect, provided herein is an antibody that binds CD8, comprising a VH having an amino acid sequence having at least 95% identity to an amino acid sequence of SEQ ID NO:371. In one aspect, provided herein is an antibody that binds CD8, comprising a VL having an amino acid sequence having at least 95% identity to an amino acid sequence of SEQ ID NO:372. In one aspect, provided herein is an antibody that binds CD8, comprising a VH having an amino acid sequence having at least 95% identity to an amino acid sequence of SEQ ID NO:371, and a VL having an amino acid sequence having at least 95% identity to an amino acid sequence of SEQ ID NO:372. In one aspect, provided herein is an antibody that binds CD8, comprising a heavy chain having an amino acid sequence having at least 95% identity to an amino acid sequence of SEQ ID NO:373. In one aspect, provided herein is an antibody that binds CD8, comprising a light chain having an amino acid sequence having at least 95% identity to an amino acid sequence of SEQ ID NO:374. In one aspect, provided herein is an antibody that binds CD8, comprising a heavy chain having an amino acid sequence having at least 95% identity to an amino acid sequence of SEQ ID NO:373, and a light chain having an amino acid sequence having at least 95% identity to an amino acid sequence of SEQ ID NO:374.

In one aspect, provided herein is an antibody that binds CD8, comprising: (i) a VH comprising a VH CDR1, a VH CDR2, and a VH CDR3 having an amino acid sequence of SEQ ID NOs:375, 376, and 377, respectively, and (ii) a VL comprising a VL CDR1, VL CDR2, and VL CDR3 having an amino acid sequence of SEQ ID NOs:378, 379, and 380, respectively. In one aspect, provided herein is an antibody that binds CD8, comprising: (i) a VH comprising a VH CDR1, a VH CDR2, and a VH CDR3 having an amino acid sequence of SEQ ID NOs:381, 382, and 383, respectively, and (ii) a VL comprising a VL CDR1, VL CDR2, and VL CDR3 having an amino acid sequence of SEQ ID NOs:384, 385, and 386, respectively. In one aspect, provided herein is an antibody that binds CD8, comprising: (i) a VH comprising a VH CDR1, a VH CDR2, and a VH CDR3 having an amino acid sequence of SEQ ID NOs:387, 388, and 389, respectively, and (ii) a VL comprising a VL CDR1, VL CDR2, and VL CDR3 having an amino acid sequence of SEQ ID NOs:390, 391, and 392, respectively. In one aspect, provided herein is an antibody that binds CD8, comprising: (i) a VH comprising a VH CDR1, a VH CDR2, and a VH CDR3 having an amino acid sequence of SEQ ID NOs:393, 394, and 395, respectively, and (ii) a VL comprising a VL CDR1, VL CDR2, and VL CDR3 having an amino acid sequence of SEQ ID NOs:396, 397, and 398, respectively. In one aspect, provided herein is an antibody that binds CD8, comprising: (i) a VH comprising a VH CDR1, a VH CDR2, and a VH CDR3 having an amino acid sequence of SEQ ID NOs:399, 400, and 401, respectively, and (ii) a VL comprising a VL CDR1, VL CDR2, and VL CDR3 having an amino acid sequence of SEQ ID NOs:402, 403, and 404, respectively. In one aspect, provided herein is an antibody that binds CD8, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:405; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:406. In one aspect, provided herein is an antibody that binds CD8, comprising a VH having an amino acid sequence of SEQ ID NO:405. In one aspect, provided herein is an antibody that binds CD8, comprising a VL having an amino acid sequence of SEQ ID NO:406. In one aspect, provided herein is an antibody that binds CD8, comprising a VH having an amino acid sequence of SEQ ID NO:405, and a VL having an amino acid sequence of SEQ ID NO:406. In one aspect, provided herein is an antibody that binds CD8, comprising a heavy chain having an amino acid sequence of SEQ ID NO:407. In one aspect, provided herein is an antibody that binds CD8, comprising a light chain having an amino acid sequence of SEQ ID NO:408. In one aspect, provided herein is an antibody that binds CD8, comprising a heavy chain having an amino acid sequence of SEQ ID NO:407, and a light chain having an amino acid sequence of SEQ ID NO:408. In one aspect, provided herein is an antibody that binds CD8, comprising a VH having an amino acid sequence having at least 95% identity to an amino acid sequence of SEQ ID NO:405. In one aspect, provided herein is an antibody that binds CD8, comprising a VL having an amino acid sequence having at least 95% identity to an amino acid sequence of SEQ ID NO:406. In one aspect, provided herein is an antibody that binds CD8, comprising a VH having an amino acid sequence having at least 95% identity to an amino acid sequence of SEQ ID NO:405, and a VL having an amino acid sequence having at least 95% identity to an amino acid sequence of SEQ ID NO:406. In one aspect, provided herein is an antibody that binds CD8, comprising a heavy chain having an amino acid sequence having at least 95% identity to an amino acid sequence of SEQ ID NO:407. In one aspect, provided herein is an antibody that binds CD8, comprising a light chain having an amino acid sequence having at least 95% identity to an amino acid sequence of SEQ ID NO:408. In one aspect, provided herein is an antibody that binds CD8, comprising a heavy chain having an amino acid sequence having at least 95% identity to an amino acid sequence of SEQ ID NO:407, and a light chain having an amino acid sequence having at least 95% identity to an amino acid sequence of SEQ ID NO:408.

In one aspect, provided herein is an antibody that binds CD8, comprising: (i) a VH comprising a VH CDR1, a VH CDR2, and a VH CDR3 having an amino acid sequence of SEQ ID NOs:409, 410, and 411, respectively, and (ii) a VL comprising a VL CDR1, VL CDR2, and VL CDR3 having an amino acid sequence of SEQ ID NOs:412, 413, and 414, respectively. In one aspect, provided herein is an antibody that binds CD8, comprising: (i) a VH comprising a VH CDR1, a VH CDR2, and a VH CDR3 having an amino acid sequence of SEQ ID NOs:415, 416, and 417, respectively, and (ii) a VL comprising a VL CDR1, VL CDR2, and VL CDR3 having an amino acid sequence of SEQ ID NOs:418, 419, and 420, respectively. In one aspect, provided herein is an antibody that binds CD8, comprising: (i) a VH comprising a VH CDR1, a VH CDR2, and a VH CDR3 having an amino acid sequence of SEQ ID NOs:421, 422, and 423, respectively, and (ii) a VL comprising a VL CDR1, VL CDR2, and VL CDR3 having an amino acid sequence of SEQ ID NOs:424, 425, and 426, respectively. In one aspect, provided herein is an antibody that binds CD8, comprising: (i) a VH comprising a VH CDR1, a VH CDR2, and a VH CDR3 having an amino acid sequence of SEQ ID NOs:427, 428, and 429, respectively, and (ii) a VL comprising a VL CDR1, VL CDR2, and VL CDR3 having an amino acid sequence of SEQ ID NOs:430, 431, and 432, respectively. In one aspect, provided herein is an antibody that binds CD8, comprising: (i) a VH comprising a VH CDR1, a VH CDR2, and a VH CDR3 having an amino acid sequence of SEQ ID NOs:433, 434, and 435, respectively, and (ii) a VL comprising a VL CDR1, VL CDR2, and VL CDR3 having an amino acid sequence of SEQ ID NOs:436, 437, and 438, respectively. In one aspect, provided herein is an antibody that binds CD8, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:439; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:440. In one aspect, provided herein is an antibody that binds CD8, comprising a VH having an amino acid sequence of SEQ ID NO:439. In one aspect, provided herein is an antibody that binds CD8, comprising a VL having an amino acid sequence of SEQ ID NO:440. In one aspect, provided herein is an antibody that binds CD8, comprising a VH having an amino acid sequence of SEQ ID NO:439, and a VL having an amino acid sequence of SEQ ID NO:440. In one aspect, provided herein is an antibody that binds CD8, comprising a heavy chain having an amino acid sequence of SEQ ID NO:441. In one aspect, provided herein is an antibody that binds CD8, comprising a light chain having an amino acid sequence of SEQ ID NO:442. In one aspect, provided herein is an antibody that binds CD8, comprising a heavy chain having an amino acid sequence of SEQ ID NO:441, and a light chain having an amino acid sequence of SEQ ID NO:442. In one aspect, provided herein is an antibody that binds CD8, comprising a VH having an amino acid sequence having at least 95% identity to an amino acid sequence of SEQ ID NO:439. In one aspect, provided herein is an antibody that binds CD8, comprising a VL having an amino acid sequence having at least 95% identity to an amino acid sequence of SEQ ID NO:440. In one aspect, provided herein is an antibody that binds CD8, comprising a VH having an amino acid sequence having at least 95% identity to an amino acid sequence of SEQ ID NO:439, and a VL having an amino acid sequence having at least 95% identity to an amino acid sequence of SEQ ID NO:440. In one aspect, provided herein is an antibody that binds CD8, comprising a heavy chain having an amino acid sequence having at least 95% identity to an amino acid sequence of SEQ ID NO:441. In one aspect, provided herein is an antibody that binds CD8, comprising a light chain having an amino acid sequence having at least 95% identity to an amino acid sequence of SEQ ID NO:442. In one aspect, provided herein is an antibody that binds CD8, comprising a heavy chain having an amino acid sequence having at least 95% identity to an amino acid sequence of SEQ ID NO:441, and a light chain having an amino acid sequence having at least 95% identity to an amino acid sequence of SEQ ID NO:442.

In one aspect, provided herein is an antibody that binds CD8, comprising: (i) a VH comprising a VH CDR1, a VH CDR2, and a VH CDR3 having an amino acid sequence of SEQ ID NOs:443, 444, and 445, respectively, and (ii) a VL comprising a VL CDR1, VL CDR2, and VL CDR3 having an amino acid sequence of SEQ ID NOs:446, 447, and 448, respectively. In one aspect, provided herein is an antibody that binds CD8, comprising: (i) a VH comprising a VH CDR1, a VH CDR2, and a VH CDR3 having an amino acid sequence of SEQ ID NOs:449, 450, and 451, respectively, and (ii) a VL comprising a VL CDR1, VL CDR2, and VL CDR3 having an amino acid sequence of SEQ ID NOs:452, 453, and 454, respectively. In one aspect, provided herein is an antibody that binds CD8, comprising: (i) a VH comprising a VH CDR1, a VH CDR2, and a VH CDR3 having an amino acid sequence of SEQ ID NOs:455, 456, and 457, respectively, and (ii) a VL comprising a VL CDR1, VL CDR2, and VL CDR3 having an amino acid sequence of SEQ ID NOs:458, 459, and 460, respectively. In one aspect, provided herein is an antibody that binds CD8, comprising: (i) a VH comprising a VH CDR1, a VH CDR2, and a VH CDR3 having an amino acid sequence of SEQ ID NOs:461, 462, and 463, respectively, and (ii) a VL comprising a VL CDR1, VL CDR2, and VL CDR3 having an amino acid sequence of SEQ ID NOs:464, 465, and 466, respectively. In one aspect, provided herein is an antibody that binds CD8, comprising: (i) a VH comprising a VH CDR1, a VH CDR2, and a VH CDR3 having an amino acid sequence of SEQ ID NOs:467, 468, and 469, respectively, and (ii) a VL comprising a VL CDR1, VL CDR2, and VL CDR3 having an amino acid sequence of SEQ ID NOs:470, 471, and 472, respectively. In one aspect, provided herein is an antibody that binds CD8, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:473; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:474. In one aspect, provided herein is an antibody that binds CD8, comprising a VH having an amino acid sequence of SEQ ID NO:473. In one aspect, provided herein is an antibody that binds CD8, comprising a VL having an amino acid sequence of SEQ ID NO:474. In one aspect, provided herein is an antibody that binds CD8, comprising a VH having an amino acid sequence of SEQ ID NO:473, and a VL having an amino acid sequence of SEQ ID NO:474. In one aspect, provided herein is an antibody that binds CD8, comprising a heavy chain having an amino acid sequence of SEQ ID NO:475. In one aspect, provided herein is an antibody that binds CD8, comprising a light chain having an amino acid sequence of SEQ ID NO:476. In one aspect, provided herein is an antibody that binds CD8, comprising a heavy chain having an amino acid sequence of SEQ ID NO:475, and a light chain having an amino acid sequence of SEQ ID NO:476. In one aspect, provided herein is an antibody that binds CD8, comprising a VH having an amino acid sequence having at least 95% identity to an amino acid sequence of SEQ ID NO:473. In one aspect, provided herein is an antibody that binds CD8, comprising a VL having an amino acid sequence having at least 95% identity to an amino acid sequence of SEQ ID NO:474. In one aspect, provided herein is an antibody that binds CD8, comprising a VH having an amino acid sequence having at least 95% identity to an amino acid sequence of SEQ ID NO:473, and a VL having an amino acid sequence having at least 95% identity to an amino acid sequence of SEQ ID NO:474. In one aspect, provided herein is an antibody that binds CD8, comprising a heavy chain having an amino acid sequence having at least 95% identity to an amino acid sequence of SEQ ID NO:475. In one aspect, provided herein is an antibody that binds CD8, comprising a light chain having an amino acid sequence having at least 95% identity to an amino acid sequence of SEQ ID NO:476. In one aspect, provided herein is an antibody that binds CD8, comprising a heavy chain having an amino acid sequence having at least 95% identity to an amino acid sequence of SEQ ID NO:475, and a light chain having an amino acid sequence having at least 95% identity to an amino acid sequence of SEQ ID NO:476.

In one aspect, provided herein is an antibody that binds CD8, comprising: (i) a VH comprising a VH CDR1, a VH CDR2, and a VH CDR3 having an amino acid sequence of SEQ ID NOs:477, 478, and 479, respectively, and (ii) a VL comprising a VL CDR1, VL CDR2, and VL CDR3 having an amino acid sequence of SEQ ID NOs:480, 481, and 482, respectively. In one aspect, provided herein is an antibody that binds CD8, comprising: (i) a VH comprising a VH CDR1, a VH CDR2, and a VH CDR3 having an amino acid sequence of SEQ ID NOs:483, 484, and 485, respectively, and (ii) a VL comprising a VL CDR1, VL CDR2, and VL CDR3 having an amino acid sequence of SEQ ID NOs:486, 487, and 488, respectively. In one aspect, provided herein is an antibody that binds CD8, comprising: (i) a VH comprising a VH CDR1, a VH CDR2, and a VH CDR3 having an amino acid sequence of SEQ ID NOs:489, 490, and 491, respectively, and (ii) a VL comprising a VL CDR1, VL CDR2, and VL CDR3 having an amino acid sequence of SEQ ID NOs:492, 493, and 494, respectively. In one aspect, provided herein is an antibody that binds CD8, comprising: (i) a VH comprising a VH CDR1, a VH CDR2, and a VH CDR3 having an amino acid sequence of SEQ ID NOs:495, 496, and 497, respectively, and (ii) a VL comprising a VL CDR1, VL CDR2, and VL CDR3 having an amino acid sequence of SEQ ID NOs:498, 499, and 500, respectively. In one aspect, provided herein is an antibody that binds CD8, comprising: (i) a VH comprising a VH CDR1, a VH CDR2, and a VH CDR3 having an amino acid sequence of SEQ ID NOs:501, 502, and 503, respectively, and (ii) a VL comprising a VL CDR1, VL CDR2, and VL CDR3 having an amino acid sequence of SEQ ID NOs:504, 505, and 506, respectively. In one aspect, provided herein is an antibody that binds CD8, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:507; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:508. In one aspect, provided herein is an antibody that binds CD8, comprising a VH having an amino acid sequence of SEQ ID NO:507. In one aspect, provided herein is an antibody that binds CD8, comprising a VL having an amino acid sequence of SEQ ID NO:508. In one aspect, provided herein is an antibody that binds CD8, comprising a VH having an amino acid sequence of SEQ ID NO:507, and a VL having an amino acid sequence of SEQ ID NO:508. In one aspect, provided herein is an antibody that binds CD8, comprising a heavy chain having an amino acid sequence of SEQ ID NO:509. In one aspect, provided herein is an antibody that binds CD8, comprising a light chain having an amino acid sequence of SEQ ID NO:510. In one aspect, provided herein is an antibody that binds CD8, comprising a heavy chain having an amino acid sequence of SEQ ID NO:509, and a light chain having an amino acid sequence of SEQ ID NO:510. In one aspect, provided herein is an antibody that binds CD8, comprising a VH having an amino acid sequence having at least 95% identity to an amino acid sequence of SEQ ID NO:507. In one aspect, provided herein is an antibody that binds CD8, comprising a VL having an amino acid sequence having at least 95% identity to an amino acid sequence of SEQ ID NO:508. In one aspect, provided herein is an antibody that binds CD8, comprising a VH having an amino acid sequence having at least 95% identity to an amino acid sequence of SEQ ID NO:507, and a VL having an amino acid sequence having at least 95% identity to an amino acid sequence of SEQ ID NO:508. In one aspect, provided herein is an antibody that binds CD8, comprising a heavy chain having an amino acid sequence having at least 95% identity to an amino acid sequence of SEQ ID NO:509. In one aspect, provided herein is an antibody that binds CD8, comprising a light chain having an amino acid sequence having at least 95% identity to an amino acid sequence of SEQ ID NO:510. In one aspect, provided herein is an antibody that binds CD8, comprising a heavy chain having an amino acid sequence having at least 95% identity to an amino acid sequence of SEQ ID NO:509, and a light chain having an amino acid sequence having at least 95% identity to an amino acid sequence of SEQ ID NO:510.

In one aspect, provided herein is an antibody that binds CD8, comprising: (i) a VH comprising a VH CDR1, a VH CDR2, and a VH CDR3 having an amino acid sequence of SEQ ID NOs:511, 512, and 513, respectively, and (ii) a VL comprising a VL CDR1, VL CDR2, and VL CDR3 having an amino acid sequence of SEQ ID NOs:514, 515, and 516, respectively. In one aspect, provided herein is an antibody that binds CD8, comprising: (i) a VH comprising a VH CDR1, a VH CDR2, and a VH CDR3 having an amino acid sequence of SEQ ID NOs:517, 518, and 519, respectively, and (ii) a VL comprising a VL CDR1, VL CDR2, and VL CDR3 having an amino acid sequence of SEQ ID NOs:520, 521, and 522, respectively. In one aspect, provided herein is an antibody that binds CD8, comprising: (i) a VH comprising a VH CDR1, a VH CDR2, and a VH CDR3 having an amino acid sequence of SEQ ID NOs:523, 524, and 525, respectively, and (ii) a VL comprising a VL CDR1, VL CDR2, and VL CDR3 having an amino acid sequence of SEQ ID NOs:526, 527, and 528, respectively. In one aspect, provided herein is an antibody that binds CD8, comprising: (i) a VH comprising a VH CDR1, a VH CDR2, and a VH CDR3 having an amino acid sequence of SEQ ID NOs:529, 530, and 531, respectively, and (ii) a VL comprising a VL CDR1, VL CDR2, and VL CDR3 having an amino acid sequence of SEQ ID NOs:532, 533, and 534, respectively. In one aspect, provided herein is an antibody that binds CD8, comprising: (i) a VH comprising a VH CDR1, a VH CDR2, and a VH CDR3 having an amino acid sequence of SEQ ID NOs:535, 536, and 537, respectively, and (ii) a VL comprising a VL CDR1, VL CDR2, and VL CDR3 having an amino acid sequence of SEQ ID NOs:538, 539, and 540, respectively. In one aspect, provided herein is an antibody that binds CD8, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:541; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:542. In one aspect, provided herein is an antibody that binds CD8, comprising a VH having an amino acid sequence of SEQ ID NO:541. In one aspect, provided herein is an antibody that binds CD8, comprising a VL having an amino acid sequence of SEQ ID NO:542. In one aspect, provided herein is an antibody that binds CD8, comprising a VH having an amino acid sequence of SEQ ID NO:541, and a VL having an amino acid sequence of SEQ ID NO:542. In one aspect, provided herein is an antibody that binds CD8, comprising a heavy chain having an amino acid sequence of SEQ ID NO:543. In one aspect, provided herein is an antibody that binds CD8, comprising a light chain having an amino acid sequence of SEQ ID NO:544. In one aspect, provided herein is an antibody that binds CD8, comprising a heavy chain having an amino acid sequence of SEQ ID NO:543, and a light chain having an amino acid sequence of SEQ ID NO:544. In one aspect, provided herein is an antibody that binds CD8, comprising a VH having an amino acid sequence having at least 95% identity to an amino acid sequence of SEQ ID NO:541. In one aspect, provided herein is an antibody that binds CD8, comprising a VL having an amino acid sequence having at least 95% identity to an amino acid sequence of SEQ ID NO:542. In one aspect, provided herein is an antibody that binds CD8, comprising a VH having an amino acid sequence having at least 95% identity to an amino acid sequence of SEQ ID NO:541, and a VL having an amino acid sequence having at least 95% identity to an amino acid sequence of SEQ ID NO:542. In one aspect, provided herein is an antibody that binds CD8, comprising a heavy chain having an amino acid sequence having at least 95% identity to an amino acid sequence of SEQ ID NO:543. In one aspect, provided herein is an antibody that binds CD8, comprising a light chain having an amino acid sequence having at least 95% identity to an amino acid sequence of SEQ ID NO:544. In one aspect, provided herein is an antibody that binds CD8, comprising a heavy chain having an amino acid sequence having at least 95% identity to an amino acid sequence of SEQ ID NO:543, and a light chain having an amino acid sequence having at least 95% identity to an amino acid sequence of SEQ ID NO:544.

In one aspect, provided herein is an antibody that binds CD8, comprising: (i) a VH comprising a VH CDR1, a VH CDR2, and a VH CDR3 having an amino acid sequence of SEQ ID NOs:545, 546, and 547, respectively, and (ii) a VL comprising a VL CDR1, VL CDR2, and VL CDR3 having an amino acid sequence of SEQ ID NOs:548, 549, and 550, respectively. In one aspect, provided herein is an antibody that binds CD8, comprising: (i) a VH comprising a VH CDR1, a VH CDR2, and a VH CDR3 having an amino acid sequence of SEQ ID NOs:551, 552, and 553, respectively, and (ii) a VL comprising a VL CDR1, VL CDR2, and VL CDR3 having an amino acid sequence of SEQ ID NOs:554, 555, and 556, respectively. In one aspect, provided herein is an antibody that binds CD8, comprising: (i) a VH comprising a VH CDR1, a VH CDR2, and a VH CDR3 having an amino acid sequence of SEQ ID NOs:557, 558, and 559, respectively, and (ii) a VL comprising a VL CDR1, VL CDR2, and VL CDR3 having an amino acid sequence of SEQ ID NOs:560, 561, and 562, respectively. In one aspect, provided herein is an antibody that binds CD8, comprising: (i) a VH comprising a VH CDR1, a VH CDR2, and a VH CDR3 having an amino acid sequence of SEQ ID NOs:563, 564, and 565, respectively, and (ii) a VL comprising a VL CDR1, VL CDR2, and VL CDR3 having an amino acid sequence of SEQ ID NOs:566, 567, and 568, respectively. In one aspect, provided herein is an antibody that binds CD8, comprising: (i) a VH comprising a VH CDR1, a VH CDR2, and a VH CDR3 having an amino acid sequence of SEQ ID NOs:569, 570, and 571, respectively, and (ii) a VL comprising a VL CDR1, VL CDR2, and VL CDR3 having an amino acid sequence of SEQ ID NOs:572, 573, and 574, respectively. In one aspect, provided herein is an antibody that binds CD8, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:575; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:576. In one aspect, provided herein is an antibody that binds CD8, comprising a VH having an amino acid sequence of SEQ ID NO:575. In one aspect, provided herein is an antibody that binds CD8, comprising a VL having an amino acid sequence of SEQ ID NO:576. In one aspect, provided herein is an antibody that binds CD8, comprising a VH having an amino acid sequence of SEQ ID NO:575, and a VL having an amino acid sequence of SEQ ID NO:576. In one aspect, provided herein is an antibody that binds CD8, comprising a heavy chain having an amino acid sequence of SEQ ID NO:577. In one aspect, provided herein is an antibody that binds CD8, comprising a light chain having an amino acid sequence of SEQ ID NO:578. In one aspect, provided herein is an antibody that binds CD8, comprising a heavy chain having an amino acid sequence of SEQ ID NO:577, and a light chain having an amino acid sequence of SEQ ID NO:578. In one aspect, provided herein is an antibody that binds CD8, comprising a VH having an amino acid sequence having at least 95% identity to an amino acid sequence of SEQ ID NO:575. In one aspect, provided herein is an antibody that binds CD8, comprising a VL having an amino acid sequence having at least 95% identity to an amino acid sequence of SEQ ID NO:576. In one aspect, provided herein is an antibody that binds CD8, comprising a VH having an amino acid sequence having at least 95% identity to an amino acid sequence of SEQ ID NO:575, and a VL having an amino acid sequence having at least 95% identity to an amino acid sequence of SEQ ID NO:576. In one aspect, provided herein is an antibody that binds CD8, comprising a heavy chain having an amino acid sequence having at least 95% identity to an amino acid sequence of SEQ ID NO:577. In one aspect, provided herein is an antibody that binds CD8, comprising a light chain having an amino acid sequence having at least 95% identity to an amino acid sequence of SEQ ID NO:578. In one aspect, provided herein is an antibody that binds CD8, comprising a heavy chain having an amino acid sequence having at least 95% identity to an amino acid sequence of SEQ ID NO:577, and a light chain having an amino acid sequence having at least 95% identity to an amino acid sequence of SEQ ID NO:578.

In one aspect, provided herein is an antibody that binds CD8, comprising: (i) a VH comprising a VH CDR1, a VH CDR2, and a VH CDR3 having an amino acid sequence of SEQ ID NOs:579, 580, and 581, respectively, and (ii) a VL comprising a VL CDR1, VL CDR2, and VL CDR3 having an amino acid sequence of SEQ ID NOs:582, 583, and 584, respectively. In one aspect, provided herein is an antibody that binds CD8, comprising: (i) a VH comprising a VH CDR1, a VH CDR2, and a VH CDR3 having an amino acid sequence of SEQ ID NOs:585, 586, and 587, respectively, and (ii) a VL comprising a VL CDR1, VL CDR2, and VL CDR3 having an amino acid sequence of SEQ ID NOs:588, 589, and 590, respectively. In one aspect, provided herein is an antibody that binds CD8, comprising: (i) a VH comprising a VH CDR1, a VH CDR2, and a VH CDR3 having an amino acid sequence of SEQ ID NOs:591, 592, and 593, respectively, and (ii) a VL comprising a VL CDR1, VL CDR2, and VL CDR3 having an amino acid sequence of SEQ ID NOs:594, 595, and 596, respectively. In one aspect, provided herein is an antibody that binds CD8, comprising: (i) a VH comprising a VH CDR1, a VH CDR2, and a VH CDR3 having an amino acid sequence of SEQ ID NOs:597, 598, and 599, respectively, and (ii) a VL comprising a VL CDR1, VL CDR2, and VL CDR3 having an amino acid sequence of SEQ ID NOs:600, 601, and 602, respectively. In one aspect, provided herein is an antibody that binds CD8, comprising: (i) a VH comprising a VH CDR1, a VH CDR2, and a VH CDR3 having an amino acid sequence of SEQ ID NOs:603, 604, and 605, respectively, and (ii) a VL comprising a VL CDR1, VL CDR2, and VL CDR3 having an amino acid sequence of SEQ ID NOs:606, 607, and 608, respectively. In one aspect, provided herein is an antibody that binds CD8, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:609; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:610. In one aspect, provided herein is an antibody that binds CD8, comprising a VH having an amino acid sequence of SEQ ID NO:609. In one aspect, provided herein is an antibody that binds CD8, comprising a VL having an amino acid sequence of SEQ ID NO:610. In one aspect, provided herein is an antibody that binds CD8, comprising a VH having an amino acid sequence of SEQ ID NO:609, and a VL having an amino acid sequence of SEQ ID NO:610. In one aspect, provided herein is an antibody that binds CD8, comprising a heavy chain having an amino acid sequence of SEQ ID NO:611. In one aspect, provided herein is an antibody that binds CD8, comprising a light chain having an amino acid sequence of SEQ ID NO:612. In one aspect, provided herein is an antibody that binds CD8, comprising a heavy chain having an amino acid sequence of SEQ ID NO:611, and a light chain having an amino acid sequence of SEQ ID NO:612. In one aspect, provided herein is an antibody that binds CD8, comprising a VH having an amino acid sequence having at least 95% identity to an amino acid sequence of SEQ ID NO:609. In one aspect, provided herein is an antibody that binds CD8, comprising a VL having an amino acid sequence having at least 95% identity to an amino acid sequence of SEQ ID NO:610. In one aspect, provided herein is an antibody that binds CD8, comprising a VH having an amino acid sequence having at least 95% identity to an amino acid sequence of SEQ ID NO:609, and a VL having an amino acid sequence having at least 95% identity to an amino acid sequence of SEQ ID NO:610. In one aspect, provided herein is an antibody that binds CD8, comprising a heavy chain having an amino acid sequence having at least 95% identity to an amino acid sequence of SEQ ID NO:611. In one aspect, provided herein is an antibody that binds CD8, comprising a light chain having an amino acid sequence having at least 95% identity to an amino acid sequence of SEQ ID NO:612. In one aspect, provided herein is an antibody that binds CD8, comprising a heavy chain having an amino acid sequence having at least 95% identity to an amino acid sequence of SEQ ID NO:611, and a light chain having an amino acid sequence having at least 95% identity to an amino acid sequence of SEQ ID NO:612.

In one aspect, provided herein is an antibody that binds CD8, comprising: (i) a VH comprising a VH CDR1, a VH CDR2, and a VH CDR3 having an amino acid sequence of SEQ ID NOs:613, 614, and 615, respectively, and (ii) a VL comprising a VL CDR1, VL CDR2, and VL CDR3 having an amino acid sequence of SEQ ID NOs:616, 617, and 618, respectively. In one aspect, provided herein is an antibody that binds CD8, comprising: (i) a VH comprising a VH CDR1, a VH CDR2, and a VH CDR3 having an amino acid sequence of SEQ ID NOs:619, 620, and 621, respectively, and (ii) a VL comprising a VL CDR1, VL CDR2, and VL CDR3 having an amino acid sequence of SEQ ID NOs:622, 523, and 624, respectively. In one aspect, provided herein is an antibody that binds CD8, comprising: (i) a VH comprising a VH CDR1, a VH CDR2, and a VH CDR3 having an amino acid sequence of SEQ ID NOs:625, 626, and 627, respectively, and (ii) a VL comprising a VL CDR1, VL CDR2, and VL CDR3 having an amino acid sequence of SEQ ID NOs:628, 629, and 630, respectively. In one aspect, provided herein is an antibody that binds CD8, comprising: (i) a VH comprising a VH CDR1, a VH CDR2, and a VH CDR3 having an amino acid sequence of SEQ ID NOs:631, 632, and 633, respectively, and (ii) a VL comprising a VL CDR1, VL CDR2, and VL CDR3 having an amino acid sequence of SEQ ID NOs:634, 635, and 636, respectively. In one aspect, provided herein is an antibody that binds CD8, comprising: (i) a VH comprising a VH CDR1, a VH CDR2, and a VH CDR3 having an amino acid sequence of SEQ ID NOs:637, 638, and 639, respectively, and (ii) a VL comprising a VL CDR1, VL CDR2, and VL CDR3 having an amino acid sequence of SEQ ID NOs:640, 641, and 642, respectively. In one aspect, provided herein is an antibody that binds CD8, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:643; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:644. In one aspect, provided herein is an antibody that binds CD8, comprising a VH having an amino acid sequence of SEQ ID NO:643. In one aspect, provided herein is an antibody that binds CD8, comprising a VL having an amino acid sequence of SEQ ID NO:644. In one aspect, provided herein is an antibody that binds CD8, comprising a VH having an amino acid sequence of SEQ ID NO:643, and a VL having an amino acid sequence of SEQ ID NO:644. In one aspect, provided herein is an antibody that binds CD8, comprising a heavy chain having an amino acid sequence of SEQ ID NO:645. In one aspect, provided herein is an antibody that binds CD8, comprising a light chain having an amino acid sequence of SEQ ID NO:646. In one aspect, provided herein is an antibody that binds CD8, comprising a heavy chain having an amino acid sequence of SEQ ID NO:645, and a light chain having an amino acid sequence of SEQ ID NO:646. In one aspect, provided herein is an antibody that binds CD8, comprising a VH having an amino acid sequence having at least 95% identity to an amino acid sequence of SEQ ID NO:643. In one aspect, provided herein is an antibody that binds CD8, comprising a VL having an amino acid sequence having at least 95% identity to an amino acid sequence of SEQ ID NO:644. In one aspect, provided herein is an antibody that binds CD8, comprising a VH having an amino acid sequence having at least 95% identity to an amino acid sequence of SEQ ID NO:643, and a VL having an amino acid sequence having at least 95% identity to an amino acid sequence of SEQ ID NO:644. In one aspect, provided herein is an antibody that binds CD8, comprising a heavy chain having an amino acid sequence having at least 95% identity to an amino acid sequence of SEQ ID NO:645. In one aspect, provided herein is an antibody that binds CD8, comprising a light chain having an amino acid sequence having at least 95% identity to an amino acid sequence of SEQ ID NO:646. In one aspect, provided herein is an antibody that binds CD8, comprising a heavy chain having an amino acid sequence having at least 95% identity to an amino acid sequence of SEQ ID NO:645, and a light chain having an amino acid sequence having at least 95% identity to an amino acid sequence of SEQ ID NO:646.

In one aspect, provided herein is an antibody that binds CD8, comprising: (i) a VH comprising a VH CDR1, a VH CDR2, and a VH CDR3 having an amino acid sequence of SEQ ID NOs:647, 648, and 649, respectively, and (ii) a VL comprising a VL CDR1, VL CDR2, and VL CDR3 having an amino acid sequence of SEQ ID NOs:650, 651, and 652, respectively. In one aspect, provided herein is an antibody that binds CD8, comprising: (i) a VH comprising a VH CDR1, a VH CDR2, and a VH CDR3 having an amino acid sequence of SEQ ID NOs:653, 654, and 655, respectively, and (ii) a VL comprising a VL CDR1, VL CDR2, and VL CDR3 having an amino acid sequence of SEQ ID NOs:656, 657, and 658, respectively. In one aspect, provided herein is an antibody that binds CD8, comprising: (i) a VH comprising a VH CDR1, a VH CDR2, and a VH CDR3 having an amino acid sequence of SEQ ID NOs:659, 660, and 661, respectively, and (ii) a VL comprising a VL CDR1, VL CDR2, and VL CDR3 having an amino acid sequence of SEQ ID NOs:662, 663, and 664, respectively. In one aspect, provided herein is an antibody that binds CD8, comprising: (i) a VH comprising a VH CDR1, a VH CDR2, and a VH CDR3 having an amino acid sequence of SEQ ID NOs:665, 666, and 667, respectively, and (ii) a VL comprising a VL CDR1, VL CDR2, and VL CDR3 having an amino acid sequence of SEQ ID NOs:668, 669, and 670, respectively. In one aspect, provided herein is an antibody that binds CD8, comprising: (i) a VH comprising a VH CDR1, a VH CDR2, and a VH CDR3 having an amino acid sequence of SEQ ID NOs:671, 672, and 673, respectively, and (ii) a VL comprising a VL CDR1, VL CDR2, and VL CDR3 having an amino acid sequence of SEQ ID NOs:674, 675, and 676, respectively. In one aspect, provided herein is an antibody that binds CD8, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:677; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:678. In one aspect, provided herein is an antibody that binds CD8, comprising a VH having an amino acid sequence of SEQ ID NO:677. In one aspect, provided herein is an antibody that binds CD8, comprising a VL having an amino acid sequence of SEQ ID NO:678. In one aspect, provided herein is an antibody that binds CD8, comprising a VH having an amino acid sequence of SEQ ID NO:677, and a VL having an amino acid sequence of SEQ ID NO:678. In one aspect, provided herein is an antibody that binds CD8, comprising a heavy chain having an amino acid sequence of SEQ ID NO:679. In one aspect, provided herein is an antibody that binds CD8, comprising a light chain having an amino acid sequence of SEQ ID NO:680. In one aspect, provided herein is an antibody that binds CD8, comprising a heavy chain having an amino acid sequence of SEQ ID NO:679, and a light chain having an amino acid sequence of SEQ ID NO:680. In one aspect, provided herein is an antibody that binds CD8, comprising a VH having an amino acid sequence having at least 95% identity to an amino acid sequence of SEQ ID NO:677. In one aspect, provided herein is an antibody that binds CD8, comprising a VL having an amino acid sequence having at least 95% identity to an amino acid sequence of SEQ ID NO:678. In one aspect, provided herein is an antibody that binds CD8, comprising a VH having an amino acid sequence having at least 95% identity to an amino acid sequence of SEQ ID NO:677, and a VL having an amino acid sequence having at least 95% identity to an amino acid sequence of SEQ ID NO:678. In one aspect, provided herein is an antibody that binds CD8, comprising a heavy chain having an amino acid sequence having at least 95% identity to an amino acid sequence of SEQ ID NO:679. In one aspect, provided herein is an antibody that binds CD8, comprising a light chain having an amino acid sequence having at least 95% identity to an amino acid sequence of SEQ ID NO:680. In one aspect, provided herein is an antibody that binds CD8, comprising a heavy chain having an amino acid sequence having at least 95% identity to an amino acid sequence of SEQ ID NO:679, and a light chain having an amino acid sequence having at least 95% identity to an amino acid sequence of SEQ ID NO:680.

In one aspect, provided herein is an antibody that binds CD8, comprising: (i) a VH comprising a VH CDR1, a VH CDR2, and a VH CDR3 having an amino acid sequence of SEQ ID NOs:681, 682, and 683, respectively, and (ii) a VL comprising a VL CDR1, VL CDR2, and VL CDR3 having an amino acid sequence of SEQ ID NOs:684, 685, and 686, respectively. In one aspect, provided herein is an antibody that binds CD8, comprising: (i) a VH comprising a VH CDR1, a VH CDR2, and a VH CDR3 having an amino acid sequence of SEQ ID NOs:687, 688, and 689, respectively, and (ii) a VL comprising a VL CDR1, VL CDR2, and VL CDR3 having an amino acid sequence of SEQ ID NOs:690, 691, and 692, respectively. In one aspect, provided herein is an antibody that binds CD8, comprising: (i) a VH comprising a VH CDR1, a VH CDR2, and a VH CDR3 having an amino acid sequence of SEQ ID NOs:693, 694, and 695, respectively, and (ii) a VL comprising a VL CDR1, VL CDR2, and VL CDR3 having an amino acid sequence of SEQ ID NOs:696, 697, and 698, respectively. In one aspect, provided herein is an antibody that binds CD8, comprising: (i) a VH comprising a VH CDR1, a VH CDR2, and a VH CDR3 having an amino acid sequence of SEQ ID NOs:699, 700, and 701, respectively, and (ii) a VL comprising a VL CDR1, VL CDR2, and VL CDR3 having an amino acid sequence of SEQ ID NOs:702, 703, and 704, respectively. In one aspect, provided herein is an antibody that binds CD8, comprising: (i) a VH comprising a VH CDR1, a VH CDR2, and a VH CDR3 having an amino acid sequence of SEQ ID NOs:705, 706, and 707, respectively, and (ii) a VL comprising a VL CDR1, VL CDR2, and VL CDR3 having an amino acid sequence of SEQ ID NOs:708, 709, and 710, respectively. In one aspect, provided herein is an antibody that binds CD8, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:711; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:712. In one aspect, provided herein is an antibody that binds CD8, comprising a VH having an amino acid sequence of SEQ ID NO:711. In one aspect, provided herein is an antibody that binds CD8, comprising a VL having an amino acid sequence of SEQ ID NO:712. In one aspect, provided herein is an antibody that binds CD8, comprising a VH having an amino acid sequence of SEQ ID NO:711, and a VL having an amino acid sequence of SEQ ID NO:712. In one aspect, provided herein is an antibody that binds CD8, comprising a heavy chain having an amino acid sequence of SEQ ID NO:713. In one aspect, provided herein is an antibody that binds CD8, comprising a light chain having an amino acid sequence of SEQ ID NO:714. In one aspect, provided herein is an antibody that binds CD8, comprising a heavy chain having an amino acid sequence of SEQ ID NO:713, and a light chain having an amino acid sequence of SEQ ID NO:714. In one aspect, provided herein is an antibody that binds CD8, comprising a VH having an amino acid sequence having at least 95% identity to an amino acid sequence of SEQ ID NO:711. In one aspect, provided herein is an antibody that binds CD8, comprising a VL having an amino acid sequence having at least 95% identity to an amino acid sequence of SEQ ID NO:712. In one aspect, provided herein is an antibody that binds CD8, comprising a VH having an amino acid sequence having at least 95% identity to an amino acid sequence of SEQ ID NO:711, and a VL having an amino acid sequence having at least 95% identity to an amino acid sequence of SEQ ID NO:712. In one aspect, provided herein is an antibody that binds CD8, comprising a heavy chain having an amino acid sequence having at least 95% identity to an amino acid sequence of SEQ ID NO:713. In one aspect, provided herein is an antibody that binds CD8, comprising a light chain having an amino acid sequence having at least 95% identity to an amino acid sequence of SEQ ID NO:714. In one aspect, provided herein is an antibody that binds CD8, comprising a heavy chain having an amino acid sequence having at least 95% identity to an amino acid sequence of SEQ ID NO:713, and a light chain having an amino acid sequence having at least 95% identity to an amino acid sequence of SEQ ID NO:714.

In one aspect, provided herein is an antibody that binds CD8, comprising: (i) a VH comprising a VH CDR1, a VH CDR2, and a VH CDR3 having an amino acid sequence of SEQ ID NOs:715, 716, and 717, respectively, and (ii) a VL comprising a VL CDR1, VL CDR2, and VL CDR3 having an amino acid sequence of SEQ ID NOs:718, 719, and 720, respectively. In one aspect, provided herein is an antibody that binds CD8, comprising: (i) a VH comprising a VH CDR1, a VH CDR2, and a VH CDR3 having an amino acid sequence of SEQ ID NOs:721, 722, and 723, respectively, and (ii) a VL comprising a VL CDR1, VL CDR2, and VL CDR3 having an amino acid sequence of SEQ ID NOs:724, 725, and 726, respectively. In one aspect, provided herein is an antibody that binds CD8, comprising: (i) a VH comprising a VH CDR1, a VH CDR2, and a VH CDR3 having an amino acid sequence of SEQ ID NOs:727, 728, and 729, respectively, and (ii) a VL comprising a VL CDR1, VL CDR2, and VL CDR3 having an amino acid sequence of SEQ ID NOs:730, 731, and 732, respectively. In one aspect, provided herein is an antibody that binds CD8, comprising: (i) a VH comprising a VH CDR1, a VH CDR2, and a VH CDR3 having an amino acid sequence of SEQ ID NOs:733, 734, and 735, respectively, and (ii) a VL comprising a VL CDR1, VL CDR2, and VL CDR3 having an amino acid sequence of SEQ ID NOs:736, 737, and 738, respectively. In one aspect, provided herein is an antibody that binds CD8, comprising: (i) a VH comprising a VH CDR1, a VH CDR2, and a VH CDR3 having an amino acid sequence of SEQ ID NOs:739, 740, and 741, respectively, and (ii) a VL comprising a VL CDR1, VL CDR2, and VL CDR3 having an amino acid sequence of SEQ ID NOs:742, 743, and 744, respectively. In one aspect, provided herein is an antibody that binds CD8, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:745; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:746. In one aspect, provided herein is an antibody that binds CD8, comprising a VH having an amino acid sequence of SEQ ID NO:745. In one aspect, provided herein is an antibody that binds CD8, comprising a VL having an amino acid sequence of SEQ ID NO:746. In one aspect, provided herein is an antibody that binds CD8, comprising a VH having an amino acid sequence of SEQ ID NO:745, and a VL having an amino acid sequence of SEQ ID NO:746. In one aspect, provided herein is an antibody that binds CD8, comprising a heavy chain having an amino acid sequence of SEQ ID NO:747. In one aspect, provided herein is an antibody that binds CD8, comprising a light chain having an amino acid sequence of SEQ ID NO:748. In one aspect, provided herein is an antibody that binds CD8, comprising a heavy chain having an amino acid sequence of SEQ ID NO:747, and a light chain having an amino acid sequence of SEQ ID NO:748. In one aspect, provided herein is an antibody that binds CD8, comprising a VH having an amino acid sequence having at least 95% identity to an amino acid sequence of SEQ ID NO:745. In one aspect, provided herein is an antibody that binds CD8, comprising a VL having an amino acid sequence having at least 95% identity to an amino acid sequence of SEQ ID NO:746. In one aspect, provided herein is an antibody that binds CD8, comprising a VH having an amino acid sequence having at least 95% identity to an amino acid sequence of SEQ ID NO:745, and a VL having an amino acid sequence having at least 95% identity to an amino acid sequence of SEQ ID NO:746. In one aspect, provided herein is an antibody that binds CD8, comprising a heavy chain having an amino acid sequence having at least 95% identity to an amino acid sequence of SEQ ID NO:747. In one aspect, provided herein is an antibody that binds CD8, comprising a light chain having an amino acid sequence having at least 95% identity to an amino acid sequence of SEQ ID NO:748. In one aspect, provided herein is an antibody that binds CD8, comprising a heavy chain having an amino acid sequence having at least 95% identity to an amino acid sequence of SEQ ID NO:747, and a light chain having an amino acid sequence having at least 95% identity to an amino acid sequence of SEQ ID NO:748.

In one aspect, provided herein is an antibody that binds CD8, comprising: (i) a VH comprising a VH CDR1, a VH CDR2, and a VH CDR3 having an amino acid sequence of SEQ ID NOs:749, 750, and 751, respectively, and (ii) a VL comprising a VL CDR1, VL CDR2, and VL CDR3 having an amino acid sequence of SEQ ID NOs:752, 753, and 754, respectively. In one aspect, provided herein is an antibody that binds CD8, comprising: (i) a VH comprising a VH CDR1, a VH CDR2, and a VH CDR3 having an amino acid sequence of SEQ ID NOs:755, 756, and 757, respectively, and (ii) a VL comprising a VL CDR1, VL CDR2, and VL CDR3 having an amino acid sequence of SEQ ID NOs:758, 759, and 760, respectively. In one aspect, provided herein is an antibody that binds CD8, comprising: (i) a VH comprising a VH CDR1, a VH CDR2, and a VH CDR3 having an amino acid sequence of SEQ ID NOs:761, 762, and 763, respectively, and (ii) a VL comprising a VL CDR1, VL CDR2, and VL CDR3 having an amino acid sequence of SEQ ID NOs:764, 765, and 766, respectively. In one aspect, provided herein is an antibody that binds CD8, comprising: (i) a VH comprising a VH CDR1, a VH CDR2, and a VH CDR3 having an amino acid sequence of SEQ ID NOs:767, 768, and 769, respectively, and (ii) a VL comprising a VL CDR1, VL CDR2, and VL CDR3 having an amino acid sequence of SEQ ID NOs:770, 771, and 772, respectively. In one aspect, provided herein is an antibody that binds CD8, comprising: (i) a VH comprising a VH CDR1, a VH CDR2, and a VH CDR3 having an amino acid sequence of SEQ ID NOs:773, 774, and 775, respectively, and (ii) a VL comprising a VL CDR1, VL CDR2, and VL CDR3 having an amino acid sequence of SEQ ID NOs:776, 777, and 778, respectively. In one aspect, provided herein is an antibody that binds CD8, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:779; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:780. In one aspect, provided herein is an antibody that binds CD8, comprising a VH having an amino acid sequence of SEQ ID NO:779. In one aspect, provided herein is an antibody that binds CD8, comprising a VL having an amino acid sequence of SEQ ID NO:780. In one aspect, provided herein is an antibody that binds CD8, comprising a VH having an amino acid sequence of SEQ ID NO:779, and a VL having an amino acid sequence of SEQ ID NO:780. In one aspect, provided herein is an antibody that binds CD8, comprising a heavy chain having an amino acid sequence of SEQ ID NO:781. In one aspect, provided herein is an antibody that binds CD8, comprising a light chain having an amino acid sequence of SEQ ID NO:782. In one aspect, provided herein is an antibody that binds CD8, comprising a heavy chain having an amino acid sequence of SEQ ID NO:781, and a light chain having an amino acid sequence of SEQ ID NO:782. In one aspect, provided herein is an antibody that binds CD8, comprising a VH having an amino acid sequence having at least 95% identity to an amino acid sequence of SEQ ID NO:779. In one aspect, provided herein is an antibody that binds CD8, comprising a VL having an amino acid sequence having at least 95% identity to an amino acid sequence of SEQ ID NO:780. In one aspect, provided herein is an antibody that binds CD8, comprising a VH having an amino acid sequence having at least 95% identity to an amino acid sequence of SEQ ID NO:779, and a VL having an amino acid sequence having at least 95% identity to an amino acid sequence of SEQ ID NO:780. In one aspect, provided herein is an antibody that binds CD8, comprising a heavy chain having an amino acid sequence having at least 95% identity to an amino acid sequence of SEQ ID NO:781. In one aspect, provided herein is an antibody that binds CD8, comprising a light chain having an amino acid sequence having at least 95% identity to an amino acid sequence of SEQ ID NO:782. In one aspect, provided herein is an antibody that binds CD8, comprising a heavy chain having an amino acid sequence having at least 95% identity to an amino acid sequence of SEQ ID NO:781, and a light chain having an amino acid sequence having at least 95% identity to an amino acid sequence of SEQ ID NO:782.

In one aspect, provided herein is an antibody that binds CD8, comprising: (i) a VH comprising a VH CDR1, a VH CDR2, and a VH CDR3 having an amino acid sequence of SEQ ID NOs:783, 784, and 785, respectively, and (ii) a VL comprising a VL CDR1, VL CDR2, and VL CDR3 having an amino acid sequence of SEQ ID NOs:786, 787, and 788, respectively. In one aspect, provided herein is an antibody that binds CD8, comprising: (i) a VH comprising a VH CDR1, a VH CDR2, and a VH CDR3 having an amino acid sequence of SEQ ID NOs:789, 790, and 791, respectively, and (ii) a VL comprising a VL CDR1, VL CDR2, and VL CDR3 having an amino acid sequence of SEQ ID NOs:792, 793, and 794, respectively. In one aspect, provided herein is an antibody that binds CD8, comprising: (i) a VH comprising a VH CDR1, a VH CDR2, and a VH CDR3 having an amino acid sequence of SEQ ID NOs:795, 796, and 797, respectively, and (ii) a VL comprising a VL CDR1, VL CDR2, and VL CDR3 having an amino acid sequence of SEQ ID NOs:798, 799, and 800, respectively. In one aspect, provided herein is an antibody that binds CD8, comprising: (i) a VH comprising a VH CDR1, a VH CDR2, and a VH CDR3 having an amino acid sequence of SEQ ID NOs:801, 802, and 803, respectively, and (ii) a VL comprising a VL CDR1, VL CDR2, and VL CDR3 having an amino acid sequence of SEQ ID NOs:804, 805, and 806, respectively. In one aspect, provided herein is an antibody that binds CD8, comprising: (i) a VH comprising a VH CDR1, a VH CDR2, and a VH CDR3 having an amino acid sequence of SEQ ID NOs:807, 808, and 809, respectively, and (ii) a VL comprising a VL CDR1, VL CDR2, and VL CDR3 having an amino acid sequence of SEQ ID NOs:810, 811, and 812, respectively. In one aspect, provided herein is an antibody that binds CD8, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:813; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:814. In one aspect, provided herein is an antibody that binds CD8, comprising a VH having an amino acid sequence of SEQ ID NO:813. In one aspect, provided herein is an antibody that binds CD8, comprising a VL having an amino acid sequence of SEQ ID NO:814. In one aspect, provided herein is an antibody that binds CD8, comprising a VH having an amino acid sequence of SEQ ID NO:813, and a VL having an amino acid sequence of SEQ ID NO:814. In one aspect, provided herein is an antibody that binds CD8, comprising a heavy chain having an amino acid sequence of SEQ ID NO:815. In one aspect, provided herein is an antibody that binds CD8, comprising a light chain having an amino acid sequence of SEQ ID NO:816. In one aspect, provided herein is an antibody that binds CD8, comprising a heavy chain having an amino acid sequence of SEQ ID NO:815, and a light chain having an amino acid sequence of SEQ ID NO:816. In one aspect, provided herein is an antibody that binds CD8, comprising a VH having an amino acid sequence having at least 95% identity to an amino acid sequence of SEQ ID NO:813. In one aspect, provided herein is an antibody that binds CD8, comprising a VL having an amino acid sequence having at least 95% identity to an amino acid sequence of SEQ ID NO:814. In one aspect, provided herein is an antibody that binds CD8, comprising a VH having an amino acid sequence having at least 95% identity to an amino acid sequence of SEQ ID NO:813, and a VL having an amino acid sequence having at least 95% identity to an amino acid sequence of SEQ ID NO:814. In one aspect, provided herein is an antibody that binds CD8, comprising a heavy chain having an amino acid sequence having at least 95% identity to an amino acid sequence of SEQ ID NO:815. In one aspect, provided herein is an antibody that binds CD8, comprising a light chain having an amino acid sequence having at least 95% identity to an amino acid sequence of SEQ ID NO:816. In one aspect, provided herein is an antibody that binds CD8, comprising a heavy chain having an amino acid sequence having at least 95% identity to an amino acid sequence of SEQ ID NO:815, and a light chain having an amino acid sequence having at least 95% identity to an amino acid sequence of SEQ ID NO:816.

In one aspect, provided herein is an antibody that binds CD8, comprising: (i) a VH comprising a VH CDR1, a VH CDR2, and a VH CDR3 having an amino acid sequence of SEQ ID NOs:817, 818, and 819, respectively, and (ii) a VL comprising a VL CDR1, VL CDR2, and VL CDR3 having an amino acid sequence of SEQ ID NOs:820, 821, and 822, respectively. In one aspect, provided herein is an antibody that binds CD8, comprising: (i) a VH comprising a VH CDR1, a VH CDR2, and a VH CDR3 having an amino acid sequence of SEQ ID NOs:823, 824, and 825, respectively, and (ii) a VL comprising a VL CDR1, VL CDR2, and VL CDR3 having an amino acid sequence of SEQ ID NOs:826, 827, and 828, respectively. In one aspect, provided herein is an antibody that binds CD8, comprising: (i) a VH comprising a VH CDR1, a VH CDR2, and a VH CDR3 having an amino acid sequence of SEQ ID NOs:829, 830, and 831, respectively, and (ii) a VL comprising a VL CDR1, VL CDR2, and VL CDR3 having an amino acid sequence of SEQ ID NOs:832, 833, and 834, respectively. In one aspect, provided herein is an antibody that binds CD8, comprising: (i) a VH comprising a VH CDR1, a VH CDR2, and a VH CDR3 having an amino acid sequence of SEQ ID NOs:835, 836, and 837, respectively, and (ii) a VL comprising a VL CDR1, VL CDR2, and VL CDR3 having an amino acid sequence of SEQ ID NOs:838, 839, and 840, respectively. In one aspect, provided herein is an antibody that binds CD8, comprising: (i) a VH comprising a VH CDR1, a VH CDR2, and a VH CDR3 having an amino acid sequence of SEQ ID NOs:841, 842, and 843, respectively, and (ii) a VL comprising a VL CDR1, VL CDR2, and VL CDR3 having an amino acid sequence of SEQ ID NOs:844, 845, and 846, respectively. In one aspect, provided herein is an antibody that binds CD8, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:847; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:848. In one aspect, provided herein is an antibody that binds CD8, comprising a VH having an amino acid sequence of SEQ ID NO:847. In one aspect, provided herein is an antibody that binds CD8, comprising a VL having an amino acid sequence of SEQ ID NO:848. In one aspect, provided herein is an antibody that binds CD8, comprising a VH having an amino acid sequence of SEQ ID NO:847, and a VL having an amino acid sequence of SEQ ID NO:848. In one aspect, provided herein is an antibody that binds CD8, comprising a heavy chain having an amino acid sequence of SEQ ID NO:849. In one aspect, provided herein is an antibody that binds CD8, comprising a light chain having an amino acid sequence of SEQ ID NO:850. In one aspect, provided herein is an antibody that binds CD8, comprising a heavy chain having an amino acid sequence of SEQ ID NO:849, and a light chain having an amino acid sequence of SEQ ID NO:850. In one aspect, provided herein is an antibody that binds CD8, comprising a VH having an amino acid sequence having at least 95% identity to an amino acid sequence of SEQ ID NO:847. In one aspect, provided herein is an antibody that binds CD8, comprising a VL having an amino acid sequence having at least 95% identity to an amino acid sequence of SEQ ID NO:848. In one aspect, provided herein is an antibody that binds CD8, comprising a VH having an amino acid sequence having at least 95% identity to an amino acid sequence of SEQ ID NO:847, and a VL having an amino acid sequence having at least 95% identity to an amino acid sequence of SEQ ID NO:848. In one aspect, provided herein is an antibody that binds CD8, comprising a heavy chain having an amino acid sequence having at least 95% identity to an amino acid sequence of SEQ ID NO:849. In one aspect, provided herein is an antibody that binds CD8, comprising a light chain having an amino acid sequence having at least 95% identity to an amino acid sequence of SEQ ID NO:850. In one aspect, provided herein is an antibody that binds CD8, comprising a heavy chain having an amino acid sequence having at least 95% identity to an amino acid sequence of SEQ ID NO:849, and a light chain having an amino acid sequence having at least 95% identity to an amino acid sequence of SEQ ID NO:850.

In one aspect, provided herein is an antibody that binds CD8, comprising: (i) a VH comprising a VH CDR1, a VH CDR2, and a VH CDR3 having an amino acid sequence of SEQ ID NOs:851, 852, and 853, respectively, and (ii) a VL comprising a VL CDR1, VL CDR2, and VL CDR3 having an amino acid sequence of SEQ ID NOs:854, 855, and 856, respectively. In one aspect, provided herein is an antibody that binds CD8, comprising: (i) a VH comprising a VH CDR1, a VH CDR2, and a VH CDR3 having an amino acid sequence of SEQ ID NOs:857, 858, and 859, respectively, and (ii) a VL comprising a VL CDR1, VL CDR2, and VL CDR3 having an amino acid sequence of SEQ ID NOs:860, 861, and 862, respectively. In one aspect, provided herein is an antibody that binds CD8, comprising: (i) a VH comprising a VH CDR1, a VH CDR2, and a VH CDR3 having an amino acid sequence of SEQ ID NOs:863, 864, and 865, respectively, and (ii) a VL comprising a VL CDR1, VL CDR2, and VL CDR3 having an amino acid sequence of SEQ ID NOs:866, 867, and 868, respectively. In one aspect, provided herein is an antibody that binds CD8, comprising: (i) a VH comprising a VH CDR1, a VH CDR2, and a VH CDR3 having an amino acid sequence of SEQ ID NOs:869, 870, and 871, respectively, and (ii) a VL comprising a VL CDR1, VL CDR2, and VL CDR3 having an amino acid sequence of SEQ ID NOs:872, 873, and 874, respectively. In one aspect, provided herein is an antibody that binds CD8, comprising: (i) a VH comprising a VH CDR1, a VH CDR2, and a VH CDR3 having an amino acid sequence of SEQ ID NOs:875, 876, and 877, respectively, and (ii) a VL comprising a VL CDR1, VL CDR2, and VL CDR3 having an amino acid sequence of SEQ ID NOs:878, 879, and 880, respectively. In one aspect, provided herein is an antibody that binds CD8, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:881; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:882. In one aspect, provided herein is an antibody that binds CD8, comprising a VH having an amino acid sequence of SEQ ID NO:881. In one aspect, provided herein is an antibody that binds CD8, comprising a VL having an amino acid sequence of SEQ ID NO:882. In one aspect, provided herein is an antibody that binds CD8, comprising a VH having an amino acid sequence of SEQ ID NO:881, and a VL having an amino acid sequence of SEQ ID NO:882. In one aspect, provided herein is an antibody that binds CD8, comprising a heavy chain having an amino acid sequence of SEQ ID NO:883. In one aspect, provided herein is an antibody that binds CD8, comprising a light chain having an amino acid sequence of SEQ ID NO:884. In one aspect, provided herein is an antibody that binds CD8, comprising a heavy chain having an amino acid sequence of SEQ ID NO:883, and a light chain having an amino acid sequence of SEQ ID NO:884. In one aspect, provided herein is an antibody that binds CD8, comprising a VH having an amino acid sequence having at least 95% identity to an amino acid sequence of SEQ ID NO:881. In one aspect, provided herein is an antibody that binds CD8, comprising a VL having an amino acid sequence having at least 95% identity to an amino acid sequence of SEQ ID NO:882. In one aspect, provided herein is an antibody that binds CD8, comprising a VH having an amino acid sequence having at least 95% identity to an amino acid sequence of SEQ ID NO:881, and a VL having an amino acid sequence having at least 95% identity to an amino acid sequence of SEQ ID NO:882. In one aspect, provided herein is an antibody that binds CD8, comprising a heavy chain having an amino acid sequence having at least 95% identity to an amino acid sequence of SEQ ID NO:883. In one aspect, provided herein is an antibody that binds CD8, comprising a light chain having an amino acid sequence having at least 95% identity to an amino acid sequence of SEQ ID NO:884. In one aspect, provided herein is an antibody that binds CD8, comprising a heavy chain having an amino acid sequence having at least 95% identity to an amino acid sequence of SEQ ID NO:883, and a light chain having an amino acid sequence having at least 95% identity to an amino acid sequence of SEQ ID NO:884.

In one aspect, provided herein is an antibody that binds CD8, comprising: (i) a VH comprising a VH CDR1, a VH CDR2, and a VH CDR3 having an amino acid sequence of SEQ ID NOs:885, 886, and 887, respectively, and (ii) a VL comprising a VL CDR1, VL CDR2, and VL CDR3 having an amino acid sequence of SEQ ID NOs:888, 889, and 890, respectively. In one aspect, provided herein is an antibody that binds CD8, comprising: (i) a VH comprising a VH CDR1, a VH CDR2, and a VH CDR3 having an amino acid sequence of SEQ ID NOs:891, 892, and 893, respectively, and (ii) a VL comprising a VL CDR1, VL CDR2, and VL CDR3 having an amino acid sequence of SEQ ID NOs:894, 895, and 896, respectively. In one aspect, provided herein is an antibody that binds CD8, comprising: (i) a VH comprising a VH CDR1, a VH CDR2, and a VH CDR3 having an amino acid sequence of SEQ ID NOs:897, 898, and 899, respectively, and (ii) a VL comprising a VL CDR1, VL CDR2, and VL CDR3 having an amino acid sequence of SEQ ID NOs:900, 901, and 902, respectively. In one aspect, provided herein is an antibody that binds CD8, comprising: (i) a VH comprising a VH CDR1, a VH CDR2, and a VH CDR3 having an amino acid sequence of SEQ ID NOs:903, 904, and 905, respectively, and (ii) a VL comprising a VL CDR1, VL CDR2, and VL CDR3 having an amino acid sequence of SEQ ID NOs:906, 907, and 908, respectively. In one aspect, provided herein is an antibody that binds CD8, comprising: (i) a VH comprising a VH CDR1, a VH CDR2, and a VH CDR3 having an amino acid sequence of SEQ ID NOs:909, 910, and 911, respectively, and (ii) a VL comprising a VL CDR1, VL CDR2, and VL CDR3 having an amino acid sequence of SEQ ID NOs:912, 913, and 914, respectively. In one aspect, provided herein is an antibody that binds CD8, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:915; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:916. In one aspect, provided herein is an antibody that binds CD8, comprising a VH having an amino acid sequence of SEQ ID NO:915. In one aspect, provided herein is an antibody that binds CD8, comprising a VL having an amino acid sequence of SEQ ID NO:916. In one aspect, provided herein is an antibody that binds CD8, comprising a VH having an amino acid sequence of SEQ ID NO:915, and a VL having an amino acid sequence of SEQ ID NO:916. In one aspect, provided herein is an antibody that binds CD8, comprising a heavy chain having an amino acid sequence of SEQ ID NO:917. In one aspect, provided herein is an antibody that binds CD8, comprising a light chain having an amino acid sequence of SEQ ID NO:918. In one aspect, provided herein is an antibody that binds CD8, comprising a heavy chain having an amino acid sequence of SEQ ID NO:917, and a light chain having an amino acid sequence of SEQ ID NO:918. In one aspect, provided herein is an antibody that binds CD8, comprising a VH having an amino acid sequence having at least 95% identity to an amino acid sequence of SEQ ID NO:915. In one aspect, provided herein is an antibody that binds CD8, comprising a VL having an amino acid sequence having at least 95% identity to an amino acid sequence of SEQ ID NO:916. In one aspect, provided herein is an antibody that binds CD8, comprising a VH having an amino acid sequence having at least 95% identity to an amino acid sequence of SEQ ID NO:915, and a VL having an amino acid sequence having at least 95% identity to an amino acid sequence of SEQ ID NO:916. In one aspect, provided herein is an antibody that binds CD8, comprising a heavy chain having an amino acid sequence having at least 95% identity to an amino acid sequence of SEQ ID NO:917. In one aspect, provided herein is an antibody that binds CD8, comprising a light chain having an amino acid sequence having at least 95% identity to an amino acid sequence of SEQ ID NO:918. In one aspect, provided herein is an antibody that binds CD8, comprising a heavy chain having an amino acid sequence having at least 95% identity to an amino acid sequence of SEQ ID NO:917, and a light chain having an amino acid sequence having at least 95% identity to an amino acid sequence of SEQ ID NO:918.

In one aspect, provided herein is an antibody that binds CD8, comprising: (i) a VH comprising a VH CDR1, a VH CDR2, and a VH CDR3 having an amino acid sequence of SEQ ID NOs:919, 920, and 921, respectively, and (ii) a VL comprising a VL CDR1, VL CDR2, and VL CDR3 having an amino acid sequence of SEQ ID NOs:922, 923, and 924, respectively. In one aspect, provided herein is an antibody that binds CD8, comprising: (i) a VH comprising a VH CDR1, a VH CDR2, and a VH CDR3 having an amino acid sequence of SEQ ID NOs:925, 926, and 927, respectively, and (ii) a VL comprising a VL CDR1, VL CDR2, and VL CDR3 having an amino acid sequence of SEQ ID NOs:928, 929, and 930, respectively. In one aspect, provided herein is an antibody that binds CD8, comprising: (i) a VH comprising a VH CDR1, a VH CDR2, and a VH CDR3 having an amino acid sequence of SEQ ID NOs:931, 932, and 933, respectively, and (ii) a VL comprising a VL CDR1, VL CDR2, and VL CDR3 having an amino acid sequence of SEQ ID NOs:934, 935, and 936, respectively. In one aspect, provided herein is an antibody that binds CD8, comprising: (i) a VH comprising a VH CDR1, a VH CDR2, and a VH CDR3 having an amino acid sequence of SEQ ID NOs:937, 938, and 939, respectively, and (ii) a VL comprising a VL CDR1, VL CDR2, and VL CDR3 having an amino acid sequence of SEQ ID NOs:940, 941, and 942, respectively. In one aspect, provided herein is an antibody that binds CD8, comprising: (i) a VH comprising a VH CDR1, a VH CDR2, and a VH CDR3 having an amino acid sequence of SEQ ID NOs:943, 944, and 945, respectively, and (ii) a VL comprising a VL CDR1, VL CDR2, and VL CDR3 having an amino acid sequence of SEQ ID NOs:946, 947, and 948, respectively. In one aspect, provided herein is an antibody that binds CD8, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:949; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:950. In one aspect, provided herein is an antibody that binds CD8, comprising a VH having an amino acid sequence of SEQ ID NO:949. In one aspect, provided herein is an antibody that binds CD8, comprising a VL having an amino acid sequence of SEQ ID NO:950. In one aspect, provided herein is an antibody that binds CD8, comprising a VH having an amino acid sequence of SEQ ID NO:949, and a VL having an amino acid sequence of SEQ ID NO:950. In one aspect, provided herein is an antibody that binds CD8, comprising a heavy chain having an amino acid sequence of SEQ ID NO:951. In one aspect, provided herein is an antibody that binds CD8, comprising a light chain having an amino acid sequence of SEQ ID NO:952. In one aspect, provided herein is an antibody that binds CD8, comprising a heavy chain having an amino acid sequence of SEQ ID NO:951, and a light chain having an amino acid sequence of SEQ ID NO:952. In one aspect, provided herein is an antibody that binds CD8, comprising a VH having an amino acid sequence having at least 95% identity to an amino acid sequence of SEQ ID NO:949. In one aspect, provided herein is an antibody that binds CD8, comprising a VL having an amino acid sequence having at least 95% identity to an amino acid sequence of SEQ ID NO:950. In one aspect, provided herein is an antibody that binds CD8, comprising a VH having an amino acid sequence having at least 95% identity to an amino acid sequence of SEQ ID NO:949, and a VL having an amino acid sequence having at least 95% identity to an amino acid sequence of SEQ ID NO:950. In one aspect, provided herein is an antibody that binds CD8, comprising a heavy chain having an amino acid sequence having at least 95% identity to an amino acid sequence of SEQ ID NO:951. In one aspect, provided herein is an antibody that binds CD8, comprising a light chain having an amino acid sequence having at least 95% identity to an amino acid sequence of SEQ ID NO:952. In one aspect, provided herein is an antibody that binds CD8, comprising a heavy chain having an amino acid sequence having at least 95% identity to an amino acid sequence of SEQ ID NO:951, and a light chain having an amino acid sequence having at least 95% identity to an amino acid sequence of SEQ ID NO:952.

In one aspect, provided herein is an antibody that binds CD8, comprising: (i) a VH comprising a VH CDR1, a VH CDR2, and a VH CDR3 having an amino acid sequence of SEQ ID NOs:953, 954, and 955, respectively, and (ii) a VL comprising a VL CDR1, VL CDR2, and VL CDR3 having an amino acid sequence of SEQ ID NOs:956, 957, and 958, respectively. In one aspect, provided herein is an antibody that binds CD8, comprising: (i) a VH comprising a VH CDR1, a VH CDR2, and a VH CDR3 having an amino acid sequence of SEQ ID NOs:959, 960, and 961, respectively, and (ii) a VL comprising a VL CDR1, VL CDR2, and VL CDR3 having an amino acid sequence of SEQ ID NOs:962, 963, and 964, respectively. In one aspect, provided herein is an antibody that binds CD8, comprising: (i) a VH comprising a VH CDR1, a VH CDR2, and a VH CDR3 having an amino acid sequence of SEQ ID NOs:965, 966, and 967, respectively, and (ii) a VL comprising a VL CDR1, VL CDR2, and VL CDR3 having an amino acid sequence of SEQ ID NOs:968, 969, and 970, respectively. In one aspect, provided herein is an antibody that binds CD8, comprising: (i) a VH comprising a VH CDR1, a VH CDR2, and a VH CDR3 having an amino acid sequence of SEQ ID NOs:971, 972, and 973, respectively, and (ii) a VL comprising a VL CDR1, VL CDR2, and VL CDR3 having an amino acid sequence of SEQ ID NOs:974, 975, and 976, respectively. In one aspect, provided herein is an antibody that binds CD8, comprising: (i) a VH comprising a VH CDR1, a VH CDR2, and a VH CDR3 having an amino acid sequence of SEQ ID NOs:977, 978, and 979, respectively, and (ii) a VL comprising a VL CDR1, VL CDR2, and VL CDR3 having an amino acid sequence of SEQ ID NOs:980, 981, and 982, respectively. In one aspect, provided herein is an antibody that binds CD8, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:983; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:984. In one aspect, provided herein is an antibody that binds CD8, comprising a VH having an amino acid sequence of SEQ ID NO:983. In one aspect, provided herein is an antibody that binds CD8, comprising a VL having an amino acid sequence of SEQ ID NO:984. In one aspect, provided herein is an antibody that binds CD8, comprising a VH having an amino acid sequence of SEQ ID NO:983, and a VL having an amino acid sequence of SEQ ID NO:984. In one aspect, provided herein is an antibody that binds CD8, comprising a heavy chain having an amino acid sequence of SEQ ID NO:985. In one aspect, provided herein is an antibody that binds CD8, comprising a light chain having an amino acid sequence of SEQ ID NO:986. In one aspect, provided herein is an antibody that binds CD8, comprising a heavy chain having an amino acid sequence of SEQ ID NO:985, and a light chain having an amino acid sequence of SEQ ID NO:986. In one aspect, provided herein is an antibody that binds CD8, comprising a VH having an amino acid sequence having at least 95% identity to an amino acid sequence of SEQ ID NO:983. In one aspect, provided herein is an antibody that binds CD8, comprising a VL having an amino acid sequence having at least 95% identity to an amino acid sequence of SEQ ID NO:984. In one aspect, provided herein is an antibody that binds CD8, comprising a VH having an amino acid sequence having at least 95% identity to an amino acid sequence of SEQ ID NO:983, and a VL having an amino acid sequence having at least 95% identity to an amino acid sequence of SEQ ID NO:984. In one aspect, provided herein is an antibody that binds CD8, comprising a heavy chain having an amino acid sequence having at least 95% identity to an amino acid sequence of SEQ ID NO:985. In one aspect, provided herein is an antibody that binds CD8, comprising a light chain having an amino acid sequence having at least 95% identity to an amino acid sequence of SEQ ID NO:986. In one aspect, provided herein is an antibody that binds CD8, comprising a heavy chain having an amino acid sequence having at least 95% identity to an amino acid sequence of SEQ ID NO:985, and a light chain having an amino acid sequence having at least 95% identity to an amino acid sequence of SEQ ID NO:986.

In one aspect, provided herein is an antibody that binds CD8, comprising: (i) a VH comprising a VH CDR1, a VH CDR2, and a VH CDR3 having an amino acid sequence of SEQ ID NOs:987, 988, and 989, respectively, and (ii) a VL comprising a VL CDR1, VL CDR2, and VL CDR3 having an amino acid sequence of SEQ ID NOs:990, 991, and 992, respectively. In one aspect, provided herein is an antibody that binds CD8, comprising: (i) a VH comprising a VH CDR1, a VH CDR2, and a VH CDR3 having an amino acid sequence of SEQ ID NOs:993, 994, and 995, respectively, and (ii) a VL comprising a VL CDR1, VL CDR2, and VL CDR3 having an amino acid sequence of SEQ ID NOs:996, 997, and 998, respectively. In one aspect, provided herein is an antibody that binds CD8, comprising: (i) a VH comprising a VH CDR1, a VH CDR2, and a VH CDR3 having an amino acid sequence of SEQ ID NOs:999, 1000, and 1001, respectively, and (ii) a VL comprising a VL CDR1, VL CDR2, and VL CDR3 having an amino acid sequence of SEQ ID NOs:1002, 1003, and 1004, respectively. In one aspect, provided herein is an antibody that binds CD8, comprising: (i) a VH comprising a VH CDR1, a VH CDR2, and a VH CDR3 having an amino acid sequence of SEQ ID NOs:1005, 1006, and 1007, respectively, and (ii) a VL comprising a VL CDR1, VL CDR2, and VL CDR3 having an amino acid sequence of SEQ ID NOs:1008, 1009, and 1010, respectively. In one aspect, provided herein is an antibody that binds CD8, comprising: (i) a VH comprising a VH CDR1, a VH CDR2, and a VH CDR3 having an amino acid sequence of SEQ ID NOs:1011, 1012, and 1013, respectively, and (ii) a VL comprising a VL CDR1, VL CDR2, and VL CDR3 having an amino acid sequence of SEQ ID NOs:1014, 1015, and 1016, respectively. In one aspect, provided herein is an antibody that binds CD8, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1017; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1018. In one aspect, provided herein is an antibody that binds CD8, comprising a VH having an amino acid sequence of SEQ ID NO:1017. In one aspect, provided herein is an antibody that binds CD8, comprising a VL having an amino acid sequence of SEQ ID NO:1018. In one aspect, provided herein is an antibody that binds CD8, comprising a VH having an amino acid sequence of SEQ ID NO:1017, and a VL having an amino acid sequence of SEQ ID NO:1018. In one aspect, provided herein is an antibody that binds CD8, comprising a heavy chain having an amino acid sequence of SEQ ID NO:1019. In one aspect, provided herein is an antibody that binds CD8, comprising a light chain having an amino acid sequence of SEQ ID NO:1020. In one aspect, provided herein is an antibody that binds CD8, comprising a heavy chain having an amino acid sequence of SEQ ID NO:1019, and a light chain having an amino acid sequence of SEQ ID NO:1020. In one aspect, provided herein is an antibody that binds CD8, comprising a VH having an amino acid sequence having at least 95% identity to an amino acid sequence of SEQ ID NO:1017. In one aspect, provided herein is an antibody that binds CD8, comprising a VL having an amino acid sequence having at least 95% identity to an amino acid sequence of SEQ ID NO:1018. In one aspect, provided herein is an antibody that binds CD8, comprising a VH having an amino acid sequence having at least 95% identity to an amino acid sequence of SEQ ID NO:1017, and a VL having an amino acid sequence having at least 95% identity to an amino acid sequence of SEQ ID NO:1018. In one aspect, provided herein is an antibody that binds CD8, comprising a heavy chain having an amino acid sequence having at least 95% identity to an amino acid sequence of SEQ ID NO:1019. In one aspect, provided herein is an antibody that binds CD8, comprising a light chain having an amino acid sequence having at least 95% identity to an amino acid sequence of SEQ ID NO:1020. In one aspect, provided herein is an antibody that binds CD8, comprising a heavy chain having an amino acid sequence having at least 95% identity to an amino acid sequence of SEQ ID NO:1019, and a light chain having an amino acid sequence having at least 95% identity to an amino acid sequence of SEQ ID NO:1020.

In one aspect, provided herein is an antibody that binds CD8, comprising: (i) a VH comprising a VH CDR1, a VH CDR2, and a VH CDR3 having an amino acid sequence of SEQ ID NOs:1021, 1022, and 1023, respectively, and (ii) a VL comprising a VL CDR1, VL CDR2, and VL CDR3 having an amino acid sequence of SEQ ID NOs:1024, 1025, and 1026, respectively. In one aspect, provided herein is an antibody that binds CD8, comprising: (i) a VH comprising a VH CDR1, a VH CDR2, and a VH CDR3 having an amino acid sequence of SEQ ID NOs:1027, 1028, and 1029, respectively, and (ii) a VL comprising a VL CDR1, VL CDR2, and VL CDR3 having an amino acid sequence of SEQ ID NOs:1030, 1031, and 1032, respectively. In one aspect, provided herein is an antibody that binds CD8, comprising: (i) a VH comprising a VH CDR1, a VH CDR2, and a VH CDR3 having an amino acid sequence of SEQ ID NOs:1033, 1034, and 1035, respectively, and (ii) a VL comprising a VL CDR1, VL CDR2, and VL CDR3 having an amino acid sequence of SEQ ID NOs:1036, 1037, and 1038, respectively. In one aspect, provided herein is an antibody that binds CD8, comprising: (i) a VH comprising a VH CDR1, a VH CDR2, and a VH CDR3 having an amino acid sequence of SEQ ID NOs:1039, 1040, and 1041, respectively, and (ii) a VL comprising a VL CDR1, VL CDR2, and VL CDR3 having an amino acid sequence of SEQ ID NOs:1042, 1043, and 1044, respectively. In one aspect, provided herein is an antibody that binds CD8, comprising: (i) a VH comprising a VH CDR1, a VH CDR2, and a VH CDR3 having an amino acid sequence of SEQ ID NOs:1045, 1046, and 1047, respectively, and (ii) a VL comprising a VL CDR1, VL CDR2, and VL CDR3 having an amino acid sequence of SEQ ID NOs:1048, 1049, and 1050, respectively. In one aspect, provided herein is an antibody that binds CD8, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1051; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1052. In one aspect, provided herein is an antibody that binds CD8, comprising a VH having an amino acid sequence of SEQ ID NO:1051. In one aspect, provided herein is an antibody that binds CD8, comprising a VL having an amino acid sequence of SEQ ID NO:1052. In one aspect, provided herein is an antibody that binds CD8, comprising a VH having an amino acid sequence of SEQ ID NO:1051, and a VL having an amino acid sequence of SEQ ID NO:1052. In one aspect, provided herein is an antibody that binds CD8, comprising a heavy chain having an amino acid sequence of SEQ ID NO:1053. In one aspect, provided herein is an antibody that binds CD8, comprising a light chain having an amino acid sequence of SEQ ID NO:1054. In one aspect, provided herein is an antibody that binds CD8, comprising a heavy chain having an amino acid sequence of SEQ ID NO:1053, and a light chain having an amino acid sequence of SEQ ID NO:1054. In one aspect, provided herein is an antibody that binds CD8, comprising a VH having an amino acid sequence having at least 95% identity to an amino acid sequence of SEQ ID NO:1051. In one aspect, provided herein is an antibody that binds CD8, comprising a VL having an amino acid sequence having at least 95% identity to an amino acid sequence of SEQ ID NO:1052. In one aspect, provided herein is an antibody that binds CD8, comprising a VH having an amino acid sequence having at least 95% identity to an amino acid sequence of SEQ ID NO:1051, and a VL having an amino acid sequence having at least 95% identity to an amino acid sequence of SEQ ID NO:1052. In one aspect, provided herein is an antibody that binds CD8, comprising a heavy chain having an amino acid sequence having at least 95% identity to an amino acid sequence of SEQ ID NO:1053. In one aspect, provided herein is an antibody that binds CD8, comprising a light chain having an amino acid sequence having at least 95% identity to an amino acid sequence of SEQ ID NO:1054. In one aspect, provided herein is an antibody that binds CD8, comprising a heavy chain having an amino acid sequence having at least 95% identity to an amino acid sequence of SEQ ID NO:1053, and a light chain having an amino acid sequence having at least 95% identity to an amino acid sequence of SEQ ID NO:1054.

In one aspect, provided herein is an antibody that binds CD8, comprising: (i) a VH comprising a VH CDR1, a VH CDR2, and a VH CDR3 having an amino acid sequence of SEQ ID NOs:1055, 1056, and 1057, respectively, and (ii) a VL comprising a VL CDR1, VL CDR2, and VL CDR3 having an amino acid sequence of SEQ ID NOs:1058, 1059, and 1060, respectively. In one aspect, provided herein is an antibody that binds CD8, comprising: (i) a VH comprising a VH CDR1, a VH CDR2, and a VH CDR3 having an amino acid sequence of SEQ ID NOs:1061, 1062, and 1063, respectively, and (ii) a VL comprising a VL CDR1, VL CDR2, and VL CDR3 having an amino acid sequence of SEQ ID NOs:1064, 1065, and 1066, respectively. In one aspect, provided herein is an antibody that binds CD8, comprising: (i) a VH comprising a VH CDR1, a VH CDR2, and a VH CDR3 having an amino acid sequence of SEQ ID NOs:1067, 1068, and 1069, respectively, and (ii) a VL comprising a VL CDR1, VL CDR2, and VL CDR3 having an amino acid sequence of SEQ ID NOs:1070, 1071, and 1072, respectively. In one aspect, provided herein is an antibody that binds CD8, comprising: (i) a VH comprising a VH CDR1, a VH CDR2, and a VH CDR3 having an amino acid sequence of SEQ ID NOs:1073, 1074, and 1075, respectively, and (ii) a VL comprising a VL CDR1, VL CDR2, and VL CDR3 having an amino acid sequence of SEQ ID NOs:1076, 1077, and 1078, respectively. In one aspect, provided herein is an antibody that binds CD8, comprising: (i) a VH comprising a VH CDR1, a VH CDR2, and a VH CDR3 having an amino acid sequence of SEQ ID NOs:1079, 1080, and 1081, respectively, and (ii) a VL comprising a VL CDR1, VL CDR2, and VL CDR3 having an amino acid sequence of SEQ ID NOs:1082, 1083, and 1084, respectively. In one aspect, provided herein is an antibody that binds CD8, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1085; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1086. In one aspect, provided herein is an antibody that binds CD8, comprising a VH having an amino acid sequence of SEQ ID NO:1085. In one aspect, provided herein is an antibody that binds CD8, comprising a VL having an amino acid sequence of SEQ ID NO:1086. In one aspect, provided herein is an antibody that binds CD8, comprising a VH having an amino acid sequence of SEQ ID NO:1085, and a VL having an amino acid sequence of SEQ ID NO:1086. In one aspect, provided herein is an antibody that binds CD8, comprising a heavy chain having an amino acid sequence of SEQ ID NO:1087. In one aspect, provided herein is an antibody that binds CD8, comprising a light chain having an amino acid sequence of SEQ ID NO:1088. In one aspect, provided herein is an antibody that binds CD8, comprising a heavy chain having an amino acid sequence of SEQ ID NO:1087, and a light chain having an amino acid sequence of SEQ ID NO:1088. In one aspect, provided herein is an antibody that binds CD8, comprising a VH having an amino acid sequence having at least 95% identity to an amino acid sequence of SEQ ID NO:1085. In one aspect, provided herein is an antibody that binds CD8, comprising a VL having an amino acid sequence having at least 95% identity to an amino acid sequence of SEQ ID NO:1086. In one aspect, provided herein is an antibody that binds CD8, comprising a VH having an amino acid sequence having at least 95% identity to an amino acid sequence of SEQ ID NO:1085, and a VL having an amino acid sequence having at least 95% identity to an amino acid sequence of SEQ ID NO:1086. In one aspect, provided herein is an antibody that binds CD8, comprising a heavy chain having an amino acid sequence having at least 95% identity to an amino acid sequence of SEQ ID NO:1087. In one aspect, provided herein is an antibody that binds CD8, comprising a light chain having an amino acid sequence having at least 95% identity to an amino acid sequence of SEQ ID NO:1088. In one aspect, provided herein is an antibody that binds CD8, comprising a heavy chain having an amino acid sequence having at least 95% identity to an amino acid sequence of SEQ ID NO:1087, and a light chain having an amino acid sequence having at least 95% identity to an amino acid sequence of SEQ ID NO:1088.

In one aspect, provided herein is an antibody that binds CD8, comprising: (i) a VH comprising a VH CDR1, a VH CDR2, and a VH CDR3 having an amino acid sequence of SEQ ID NOs:1089, 1090, and 1091, respectively, and (ii) a VL comprising a VL CDR1, VL CDR2, and VL CDR3 having an amino acid sequence of SEQ ID NOs:1092, 1093, and 1094, respectively. In one aspect, provided herein is an antibody that binds CD8, comprising: (i) a VH comprising a VH CDR1, a VH CDR2, and a VH CDR3 having an amino acid sequence of SEQ ID NOs:1095, 1096, and 1097, respectively, and (ii) a VL comprising a VL CDR1, VL CDR2, and VL CDR3 having an amino acid sequence of SEQ ID NOs:1098, 1099, and 1100, respectively. In one aspect, provided herein is an antibody that binds CD8, comprising: (i) a VH comprising a VH CDR1, a VH CDR2, and a VH CDR3 having an amino acid sequence of SEQ ID NOs:1101, 1102, and 1103, respectively, and (ii) a VL comprising a VL CDR1, VL CDR2, and VL CDR3 having an amino acid sequence of SEQ ID NOs:1104, 1105, and 1106, respectively. In one aspect, provided herein is an antibody that binds CD8, comprising: (i) a VH comprising a VH CDR1, a VH CDR2, and a VH CDR3 having an amino acid sequence of SEQ ID NOs:1107, 1108, and 1109, respectively, and (ii) a VL comprising a VL CDR1, VL CDR2, and VL CDR3 having an amino acid sequence of SEQ ID NOs:1110, 1111, and 1112, respectively. In one aspect, provided herein is an antibody that binds CD8, comprising: (i) a VH comprising a VH CDR1, a VH CDR2, and a VH CDR3 having an amino acid sequence of SEQ ID NOs:1113, 1114, and 1115, respectively, and (ii) a VL comprising a VL CDR1, VL CDR2, and VL CDR3 having an amino acid sequence of SEQ ID NOs:1116, 1117, and 1118, respectively. In one aspect, provided herein is an antibody that binds CD8, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1119; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1120. In one aspect, provided herein is an antibody that binds CD8, comprising a VH having an amino acid sequence of SEQ ID NO:1119. In one aspect, provided herein is an antibody that binds CD8, comprising a VL having an amino acid sequence of SEQ ID NO:1120. In one aspect, provided herein is an antibody that binds CD8, comprising a VH having an amino acid sequence of SEQ ID NO:1119, and a VL having an amino acid sequence of SEQ ID NO:1120. In one aspect, provided herein is an antibody that binds CD8, comprising a heavy chain having an amino acid sequence of SEQ ID NO:1121. In one aspect, provided herein is an antibody that binds CD8, comprising a light chain having an amino acid sequence of SEQ ID NO:1122. In one aspect, provided herein is an antibody that binds CD8, comprising a heavy chain having an amino acid sequence of SEQ ID NO:1121, and a light chain having an amino acid sequence of SEQ ID NO:1122. In one aspect, provided herein is an antibody that binds CD8, comprising a VH having an amino acid sequence having at least 95% identity to an amino acid sequence of SEQ ID NO:1119. In one aspect, provided herein is an antibody that binds CD8, comprising a VL having an amino acid sequence having at least 95% identity to an amino acid sequence of SEQ ID NO:1120. In one aspect, provided herein is an antibody that binds CD8, comprising a VH having an amino acid sequence having at least 95% identity to an amino acid sequence of SEQ ID NO:1119, and a VL having an amino acid sequence having at least 95% identity to an amino acid sequence of SEQ ID NO:1120. In one aspect, provided herein is an antibody that binds CD8, comprising a heavy chain having an amino acid sequence having at least 95% identity to an amino acid sequence of SEQ ID NO:1121. In one aspect, provided herein is an antibody that binds CD8, comprising a light chain having an amino acid sequence having at least 95% identity to an amino acid sequence of SEQ ID NO:1122. In one aspect, provided herein is an antibody that binds CD8, comprising a heavy chain having an amino acid sequence having at least 95% identity to an amino acid sequence of SEQ ID NO:1121, and a light chain having an amino acid sequence having at least 95% identity to an amino acid sequence of SEQ ID NO:1122.

In one aspect, provided herein is an antibody that binds CD8, comprising: (i) a VH comprising a VH CDR1, a VH CDR2, and a VH CDR3 having an amino acid sequence of SEQ ID NOs:1123, 1124, and 1125, respectively, and (ii) a VL comprising a VL CDR1, VL CDR2, and VL CDR3 having an amino acid sequence of SEQ ID NOs:1126, 1127, and 1128, respectively. In one aspect, provided herein is an antibody that binds CD8, comprising: (i) a VH comprising a VH CDR1, a VH CDR2, and a VH CDR3 having an amino acid sequence of SEQ ID NOs:1129, 1130, and 1131, respectively, and (ii) a VL comprising a VL CDR1, VL CDR2, and VL CDR3 having an amino acid sequence of SEQ ID NOs:1132, 1133, and 1134, respectively. In one aspect, provided herein is an antibody that binds CD8, comprising: (i) a VH comprising a VH CDR1, a VH CDR2, and a VH CDR3 having an amino acid sequence of SEQ ID NOs:1135, 1136, and 1137, respectively, and (ii) a VL comprising a VL CDR1, VL CDR2, and VL CDR3 having an amino acid sequence of SEQ ID NOs:1138, 1139, and 1140, respectively. In one aspect, provided herein is an antibody that binds CD8, comprising: (i) a VH comprising a VH CDR1, a VH CDR2, and a VH CDR3 having an amino acid sequence of SEQ ID NOs:1141, 1142, and 1143, respectively, and (ii) a VL comprising a VL CDR1, VL CDR2, and VL CDR3 having an amino acid sequence of SEQ ID NOs:1144, 1145, and 1146, respectively. In one aspect, provided herein is an antibody that binds CD8, comprising: (i) a VH comprising a VH CDR1, a VH CDR2, and a VH CDR3 having an amino acid sequence of SEQ ID NOs:1147, 1148, and 1149, respectively, and (ii) a VL comprising a VL CDR1, VL CDR2, and VL CDR3 having an amino acid sequence of SEQ ID NOs:1150, 1151, and 1152, respectively. In one aspect, provided herein is an antibody that binds CD8, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1153; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1154. In one aspect, provided herein is an antibody that binds CD8, comprising a VH having an amino acid sequence of SEQ ID NO:1153. In one aspect, provided herein is an antibody that binds CD8, comprising a VL having an amino acid sequence of SEQ ID NO:1154. In one aspect, provided herein is an antibody that binds CD8, comprising a VH having an amino acid sequence of SEQ ID NO:1153, and a VL having an amino acid sequence of SEQ ID NO:1154. In one aspect, provided herein is an antibody that binds CD8, comprising a heavy chain having an amino acid sequence of SEQ ID NO:1155. In one aspect, provided herein is an antibody that binds CD8, comprising a light chain having an amino acid sequence of SEQ ID NO:1156. In one aspect, provided herein is an antibody that binds CD8, comprising a heavy chain having an amino acid sequence of SEQ ID NO:1155, and a light chain having an amino acid sequence of SEQ ID NO:1156. In one aspect, provided herein is an antibody that binds CD8, comprising a VH having an amino acid sequence having at least 95% identity to an amino acid sequence of SEQ ID NO:1153. In one aspect, provided herein is an antibody that binds CD8, comprising a VL having an amino acid sequence having at least 95% identity to an amino acid sequence of SEQ ID NO:1154. In one aspect, provided herein is an antibody that binds CD8, comprising a VH having an amino acid sequence having at least 95% identity to an amino acid sequence of SEQ ID NO:1153, and a VL having an amino acid sequence having at least 95% identity to an amino acid sequence of SEQ ID NO:1154. In one aspect, provided herein is an antibody that binds CD8, comprising a heavy chain having an amino acid sequence having at least 95% identity to an amino acid sequence of SEQ ID NO:1155. In one aspect, provided herein is an antibody that binds CD8, comprising a light chain having an amino acid sequence having at least 95% identity to an amino acid sequence of SEQ ID NO:1156. In one aspect, provided herein is an antibody that binds CD8, comprising a heavy chain having an amino acid sequence having at least 95% identity to an amino acid sequence of SEQ ID NO:1155, and a light chain having an amino acid sequence having at least 95% identity to an amino acid sequence of SEQ ID NO:1156.

In one aspect, provided herein is an antibody that binds CD8, comprising: (i) a VH comprising a VH CDR1, a VH CDR2, and a VH CDR3 having an amino acid sequence of SEQ ID NOs:1157, 1158, and 1159, respectively, and (ii) a VL comprising a VL CDR1, VL CDR2, and VL CDR3 having an amino acid sequence of SEQ ID NOs:1160, 1161, and 1162, respectively. In one aspect, provided herein is an antibody that binds CD8, comprising: (i) a VH comprising a VH CDR1, a VH CDR2, and a VH CDR3 having an amino acid sequence of SEQ ID NOs:1163, 1164, and 1165, respectively, and (ii) a VL comprising a VL CDR1, VL CDR2, and VL CDR3 having an amino acid sequence of SEQ ID NOs:1166, 1167, and 1168, respectively. In one aspect, provided herein is an antibody that binds CD8, comprising: (i) a VH comprising a VH CDR1, a VH CDR2, and a VH CDR3 having an amino acid sequence of SEQ ID NOs:1169, 1170, and 1171, respectively, and (ii) a VL comprising a VL CDR1, VL CDR2, and VL CDR3 having an amino acid sequence of SEQ ID NOs:1172, 1173, and 1174, respectively. In one aspect, provided herein is an antibody that binds CD8, comprising: (i) a VH comprising a VH CDR1, a VH CDR2, and a VH CDR3 having an amino acid sequence of SEQ ID NOs:1175, 1176, and 1177, respectively, and (ii) a VL comprising a VL CDR1, VL CDR2, and VL CDR3 having an amino acid sequence of SEQ ID NOs:1178, 1179, and 1180, respectively. In one aspect, provided herein is an antibody that binds CD8, comprising: (i) a VH comprising a VH CDR1, a VH CDR2, and a VH CDR3 having an amino acid sequence of SEQ ID NOs:1181, 1182, and 1183, respectively, and (ii) a VL comprising a VL CDR1, VL CDR2, and VL CDR3 having an amino acid sequence of SEQ ID NOs:1184, 1185, and 1186, respectively. In one aspect, provided herein is an antibody that binds CD8, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1187; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1188. In one aspect, provided herein is an antibody that binds CD8, comprising a VH having an amino acid sequence of SEQ ID NO:1187. In one aspect, provided herein is an antibody that binds CD8, comprising a VL having an amino acid sequence of SEQ ID NO:1188. In one aspect, provided herein is an antibody that binds CD8, comprising a VH having an amino acid sequence of SEQ ID NO:1187, and a VL having an amino acid sequence of SEQ ID NO:1188. In one aspect, provided herein is an antibody that binds CD8, comprising a heavy chain having an amino acid sequence of SEQ ID NO:1189. In one aspect, provided herein is an antibody that binds CD8, comprising a light chain having an amino acid sequence of SEQ ID NO:1190. In one aspect, provided herein is an antibody that binds CD8, comprising a heavy chain having an amino acid sequence of SEQ ID NO:1189, and a light chain having an amino acid sequence of SEQ ID NO:1190. In one aspect, provided herein is an antibody that binds CD8, comprising a VH having an amino acid sequence having at least 95% identity to an amino acid sequence of SEQ ID NO:1187. In one aspect, provided herein is an antibody that binds CD8, comprising a VL having an amino acid sequence having at least 95% identity to an amino acid sequence of SEQ ID NO: 1188. In one aspect, provided herein is an antibody that binds CD8, comprising a VH having an amino acid sequence having at least 95% identity to an amino acid sequence of SEQ ID NO:1187, and a VL having an amino acid sequence having at least 95% identity to an amino acid sequence of SEQ ID NO:1188. In one aspect, provided herein is an antibody that binds CD8, comprising a heavy chain having an amino acid sequence having at least 95% identity to an amino acid sequence of SEQ ID NO:1189. In one aspect, provided herein is an antibody that binds CD8, comprising a light chain having an amino acid sequence having at least 95% identity to an amino acid sequence of SEQ ID NO:1190. In one aspect, provided herein is an antibody that binds CD8, comprising a heavy chain having an amino acid sequence having at least 95% identity to an amino acid sequence of SEQ ID NO:1189, and a light chain having an amino acid sequence having at least 95% identity to an amino acid sequence of SEQ ID NO:1190.

In one aspect, provided herein is an antibody that binds CD8, comprising: (i) a VH comprising a VH CDR1, a VH CDR2, and a VH CDR3 having an amino acid sequence of SEQ ID NOs:1191, 1192, and 1193, respectively, and (ii) a VL comprising a VL CDR1, VL CDR2, and VL CDR3 having an amino acid sequence of SEQ ID NOs:1194, 1195, and 1196, respectively. In one aspect, provided herein is an antibody that binds CD8, comprising: (i) a VH comprising a VH CDR1, a VH CDR2, and a VH CDR3 having an amino acid sequence of SEQ ID NOs:1197, 1198, and 1199, respectively, and (ii) a VL comprising a VL CDR1, VL CDR2, and VL CDR3 having an amino acid sequence of SEQ ID NOs:1200, 1201, and 1202, respectively. In one aspect, provided herein is an antibody that binds CD8, comprising: (i) a VH comprising a VH CDR1, a VH CDR2, and a VH CDR3 having an amino acid sequence of SEQ ID NOs:1203, 1204, and 1205, respectively, and (ii) a VL comprising a VL CDR1, VL CDR2, and VL CDR3 having an amino acid sequence of SEQ ID NOs:1206, 1207, and 1208, respectively. In one aspect, provided herein is an antibody that binds CD8, comprising: (i) a VH comprising a VH CDR1, a VH CDR2, and a VH CDR3 having an amino acid sequence of SEQ ID NOs:1209, 1210, and 1211, respectively, and (ii) a VL comprising a VL CDR1, VL CDR2, and VL CDR3 having an amino acid sequence of SEQ ID NOs:1212, 1213, and 1214, respectively. In one aspect, provided herein is an antibody that binds CD8, comprising: (i) a VH comprising a VH CDR1, a VH CDR2, and a VH CDR3 having an amino acid sequence of SEQ ID NOs:1215, 1216, and 1217, respectively, and (ii) a VL comprising a VL CDR1, VL CDR2, and VL CDR3 having an amino acid sequence of SEQ ID NOs:1218, 1219, and 1220, respectively. In one aspect, provided herein is an antibody that binds CD8, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1221; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1222. In one aspect, provided herein is an antibody that binds CD8, comprising a VH having an amino acid sequence of SEQ ID NO:1221. In one aspect, provided herein is an antibody that binds CD8, comprising a VL having an amino acid sequence of SEQ ID NO:1222. In one aspect, provided herein is an antibody that binds CD8, comprising a VH having an amino acid sequence of SEQ ID NO:1221, and a VL having an amino acid sequence of SEQ ID NO:1222. In one aspect, provided herein is an antibody that binds CD8, comprising a heavy chain having an amino acid sequence of SEQ ID NO:1223. In one aspect, provided herein is an antibody that binds CD8, comprising a light chain having an amino acid sequence of SEQ ID NO:1224. In one aspect, provided herein is an antibody that binds CD8, comprising a heavy chain having an amino acid sequence of SEQ ID NO:1223, and a light chain having an amino acid sequence of SEQ ID NO:1224. In one aspect, provided herein is an antibody that binds CD8, comprising a VH having an amino acid sequence having at least 95% identity to an amino acid sequence of SEQ ID NO:1221. In one aspect, provided herein is an antibody that binds CD8, comprising a VL having an amino acid sequence having at least 95% identity to an amino acid sequence of SEQ ID NO:1222. In one aspect, provided herein is an antibody that binds CD8, comprising a VH having an amino acid sequence having at least 95% identity to an amino acid sequence of SEQ ID NO:1221, and a VL having an amino acid sequence having at least 95% identity to an amino acid sequence of SEQ ID NO:1222. In one aspect, provided herein is an antibody that binds CD8, comprising a heavy chain having an amino acid sequence having at least 95% identity to an amino acid sequence of SEQ ID NO:1223. In one aspect, provided herein is an antibody that binds CD8, comprising a light chain having an amino acid sequence having at least 95% identity to an amino acid sequence of SEQ ID NO:1224. In one aspect, provided herein is an antibody that binds CD8, comprising a heavy chain having an amino acid sequence having at least 95% identity to an amino acid sequence of SEQ ID NO:1223, and a light chain having an amino acid sequence having at least 95% identity to an amino acid sequence of SEQ ID NO:1224.

In one aspect, provided herein is an antibody that binds CD8, comprising: (i) a VH comprising a VH CDR1, a VH CDR2, and a VH CDR3 having an amino acid sequence of SEQ ID NOs:1225, 1226, and 1227, respectively, and (ii) a VL comprising a VL CDR1, VL CDR2, and VL CDR3 having an amino acid sequence of SEQ ID NOs:1228, 1229, and 1230, respectively. In one aspect, provided herein is an antibody that binds CD8, comprising: (i) a VH comprising a VH CDR1, a VH CDR2, and a VH CDR3 having an amino acid sequence of SEQ ID NOs:1231, 1232, and 1233, respectively, and (ii) a VL comprising a VL CDR1, VL CDR2, and VL CDR3 having an amino acid sequence of SEQ ID NOs:1234, 1235, and 1236, respectively. In one aspect, provided herein is an antibody that binds CD8, comprising: (i) a VH comprising a VH CDR1, a VH CDR2, and a VH CDR3 having an amino acid sequence of SEQ ID NOs:1237, 1238, and 1239, respectively, and (ii) a VL comprising a VL CDR1, VL CDR2, and VL CDR3 having an amino acid sequence of SEQ ID NOs:1240, 1241, and 1242, respectively. In one aspect, provided herein is an antibody that binds CD8, comprising: (i) a VH comprising a VH CDR1, a VH CDR2, and a VH CDR3 having an amino acid sequence of SEQ ID NOs:1243, 1244, and 1245, respectively, and (ii) a VL comprising a VL CDR1, VL CDR2, and VL CDR3 having an amino acid sequence of SEQ ID NOs:1246, 1247, and 1248, respectively. In one aspect, provided herein is an antibody that binds CD8, comprising: (i) a VH comprising a VH CDR1, a VH CDR2, and a VH CDR3 having an amino acid sequence of SEQ ID NOs:1249, 1250, and 1251, respectively, and (ii) a VL comprising a VL CDR1, VL CDR2, and VL CDR3 having an amino acid sequence of SEQ ID NOs:1252, 1253, and 1254, respectively. In one aspect, provided herein is an antibody that binds CD8, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1255; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1256. In one aspect, provided herein is an antibody that binds CD8, comprising a VH having an amino acid sequence of SEQ ID NO:1255. In one aspect, provided herein is an antibody that binds CD8, comprising a VL having an amino acid sequence of SEQ ID NO:1256. In one aspect, provided herein is an antibody that binds CD8, comprising a VH having an amino acid sequence of SEQ ID NO:1255, and a VL having an amino acid sequence of SEQ ID NO:1256. In one aspect, provided herein is an antibody that binds CD8, comprising a heavy chain having an amino acid sequence of SEQ ID NO:1257. In one aspect, provided herein is an antibody that binds CD8, comprising a light chain having an amino acid sequence of SEQ ID NO:1258. In one aspect, provided herein is an antibody that binds CD8, comprising a heavy chain having an amino acid sequence of SEQ ID NO:1257, and a light chain having an amino acid sequence of SEQ ID NO:1258. In one aspect, provided herein is an antibody that binds CD8, comprising a VH having an amino acid sequence having at least 95% identity to an amino acid sequence of SEQ ID NO:1255. In one aspect, provided herein is an antibody that binds CD8, comprising a VL having an amino acid sequence having at least 95% identity to an amino acid sequence of SEQ ID NO:1256. In one aspect, provided herein is an antibody that binds CD8, comprising a VH having an amino acid sequence having at least 95% identity to an amino acid sequence of SEQ ID NO:1255, and a VL having an amino acid sequence having at least 95% identity to an amino acid sequence of SEQ ID NO:1256. In one aspect, provided herein is an antibody that binds CD8, comprising a heavy chain having an amino acid sequence having at least 95% identity to an amino acid sequence of SEQ ID NO:1257. In one aspect, provided herein is an antibody that binds CD8, comprising a light chain having an amino acid sequence having at least 95% identity to an amino acid sequence of SEQ ID NO:1258. In one aspect, provided herein is an antibody that binds CD8, comprising a heavy chain having an amino acid sequence having at least 95% identity to an amino acid sequence of SEQ ID NO:1257, and a light chain having an amino acid sequence having at least 95% identity to an amino acid sequence of SEQ ID NO:1258.

In one aspect, provided herein is an antibody that binds CD8, comprising: (i) a VH comprising a VH CDR1, a VH CDR2, and a VH CDR3 having an amino acid sequence of SEQ ID NOs:1259, 1260, and 1261, respectively, and (ii) a VL comprising a VL CDR1, VL CDR2, and VL CDR3 having an amino acid sequence of SEQ ID NOs:1262, 1263, and 1264, respectively. In one aspect, provided herein is an antibody that binds CD8, comprising: (i) a VH comprising a VH CDR1, a VH CDR2, and a VH CDR3 having an amino acid sequence of SEQ ID NOs:1265, 1266, and 1267, respectively, and (ii) a VL comprising a VL CDR1, VL CDR2, and VL CDR3 having an amino acid sequence of SEQ ID NOs:1268, 1269, and 1270, respectively. In one aspect, provided herein is an antibody that binds CD8, comprising: (i) a VH comprising a VH CDR1, a VH CDR2, and a VH CDR3 having an amino acid sequence of SEQ ID NOs:1271, 1272, and 1273, respectively, and (ii) a VL comprising a VL CDR1, VL CDR2, and VL CDR3 having an amino acid sequence of SEQ ID NOs:1274, 1275, and 1276, respectively. In one aspect, provided herein is an antibody that binds CD8, comprising: (i) a VH comprising a VH CDR1, a VH CDR2, and a VH CDR3 having an amino acid sequence of SEQ ID NOs:1277, 1278, and 1279, respectively, and (ii) a VL comprising a VL CDR1, VL CDR2, and VL CDR3 having an amino acid sequence of SEQ ID NOs:1280, 1281, and 1282, respectively. In one aspect, provided herein is an antibody that binds CD8, comprising: (i) a VH comprising a VH CDR1, a VH CDR2, and a VH CDR3 having an amino acid sequence of SEQ ID NOs:1283, 1284, and 1285, respectively, and (ii) a VL comprising a VL CDR1, VL CDR2, and VL CDR3 having an amino acid sequence of SEQ ID NOs:1286, 1287, and 1288, respectively. In one aspect, provided herein is an antibody that binds CD8, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1289; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1290. In one aspect, provided herein is an antibody that binds CD8, comprising a VH having an amino acid sequence of SEQ ID NO:1289. In one aspect, provided herein is an antibody that binds CD8, comprising a VL having an amino acid sequence of SEQ ID NO:1290. In one aspect, provided herein is an antibody that binds CD8, comprising a VH having an amino acid sequence of SEQ ID NO:1289, and a VL having an amino acid sequence of SEQ ID NO:1290. In one aspect, provided herein is an antibody that binds CD8, comprising a heavy chain having an amino acid sequence of SEQ ID NO:1291. In one aspect, provided herein is an antibody that binds CD8, comprising a light chain having an amino acid sequence of SEQ ID NO:1292. In one aspect, provided herein is an antibody that binds CD8, comprising a heavy chain having an amino acid sequence of SEQ ID NO:1291, and a light chain having an amino acid sequence of SEQ ID NO:1292. In one aspect, provided herein is an antibody that binds CD8, comprising a VH having an amino acid sequence having at least 95% identity to an amino acid sequence of SEQ ID NO:1289. In one aspect, provided herein is an antibody that binds CD8, comprising a VL having an amino acid sequence having at least 95% identity to an amino acid sequence of SEQ ID NO:1290. In one aspect, provided herein is an antibody that binds CD8, comprising a VH having an amino acid sequence having at least 95% identity to an amino acid sequence of SEQ ID NO:1289, and a VL having an amino acid sequence having at least 95% identity to an amino acid sequence of SEQ ID NO:1290. In one aspect, provided herein is an antibody that binds CD8, comprising a heavy chain having an amino acid sequence having at least 95% identity to an amino acid sequence of SEQ ID NO:1291. In one aspect, provided herein is an antibody that binds CD8, comprising a light chain having an amino acid sequence having at least 95% identity to an amino acid sequence of SEQ ID NO:1292. In one aspect, provided herein is an antibody that binds CD8, comprising a heavy chain having an amino acid sequence having at least 95% identity to an amino acid sequence of SEQ ID NO:1291, and a light chain having an amino acid sequence having at least 95% identity to an amino acid sequence of SEQ ID NO:1292.

In one aspect, provided herein is an antibody that binds CD8, comprising: (i) a VH comprising a VH CDR1, a VH CDR2, and a VH CDR3 having an amino acid sequence of SEQ ID NOs:1293, 1294, and 1295, respectively, and (ii) a VL comprising a VL CDR1, VL CDR2, and VL CDR3 having an amino acid sequence of SEQ ID NOs:1296, 1297, and 1298, respectively. In one aspect, provided herein is an antibody that binds CD8, comprising: (i) a VH comprising a VH CDR1, a VH CDR2, and a VH CDR3 having an amino acid sequence of SEQ ID NOs:1299, 1300, and 1301, respectively, and (ii) a VL comprising a VL CDR1, VL CDR2, and VL CDR3 having an amino acid sequence of SEQ ID NOs:1302, 1303, and 1304, respectively. In one aspect, provided herein is an antibody that binds CD8, comprising: (i) a VH comprising a VH CDR1, a VH CDR2, and a VH CDR3 having an amino acid sequence of SEQ ID NOs:1305, 1306, and 1307, respectively, and (ii) a VL comprising a VL CDR1, VL CDR2, and VL CDR3 having an amino acid sequence of SEQ ID NOs:1308, 1309, and 1310, respectively. In one aspect, provided herein is an antibody that binds CD8, comprising: (i) a VH comprising a VH CDR1, a VH CDR2, and a VH CDR3 having an amino acid sequence of SEQ ID NOs:1311, 1312, and 1313, respectively, and (ii) a VL comprising a VL CDR1, VL CDR2, and VL CDR3 having an amino acid sequence of SEQ ID NOs:1314, 1315, and 1316, respectively. In one aspect, provided herein is an antibody that binds CD8, comprising: (i) a VH comprising a VH CDR1, a VH CDR2, and a VH CDR3 having an amino acid sequence of SEQ ID NOs:1317, 1318, and 1319, respectively, and (ii) a VL comprising a VL CDR1, VL CDR2, and VL CDR3 having an amino acid sequence of SEQ ID NOs:1320, 1321, and 1322, respectively. In one aspect, provided herein is an antibody that binds CD8, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1323; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1324. In one aspect, provided herein is an antibody that binds CD8, comprising a VH having an amino acid sequence of SEQ ID NO:1323. In one aspect, provided herein is an antibody that binds CD8, comprising a VL having an amino acid sequence of SEQ ID NO:1324. In one aspect, provided herein is an antibody that binds CD8, comprising a VH having an amino acid sequence of SEQ ID NO:1323, and a VL having an amino acid sequence of SEQ ID NO:1324. In one aspect, provided herein is an antibody that binds CD8, comprising a heavy chain having an amino acid sequence of SEQ ID NO:1325. In one aspect, provided herein is an antibody that binds CD8, comprising a light chain having an amino acid sequence of SEQ ID NO:1326. In one aspect, provided herein is an antibody that binds CD8, comprising a heavy chain having an amino acid sequence of SEQ ID NO:1325, and a light chain having an amino acid sequence of SEQ ID NO:1326. In one aspect, provided herein is an antibody that binds CD8, comprising a VH having an amino acid sequence having at least 95% identity to an amino acid sequence of SEQ ID NO:1323. In one aspect, provided herein is an antibody that binds CD8, comprising a VL having an amino acid sequence having at least 95% identity to an amino acid sequence of SEQ ID NO:1324. In one aspect, provided herein is an antibody that binds CD8, comprising a VH having an amino acid sequence having at least 95% identity to an amino acid sequence of SEQ ID NO:1323, and a VL having an amino acid sequence having at least 95% identity to an amino acid sequence of SEQ ID NO:1324. In one aspect, provided herein is an antibody that binds CD8, comprising a heavy chain having an amino acid sequence having at least 95% identity to an amino acid sequence of SEQ ID NO:1325. In one aspect, provided herein is an antibody that binds CD8, comprising a light chain having an amino acid sequence having at least 95% identity to an amino acid sequence of SEQ ID NO:1326. In one aspect, provided herein is an antibody that binds CD8, comprising a heavy chain having an amino acid sequence having at least 95% identity to an amino acid sequence of SEQ ID NO:1325, and a light chain having an amino acid sequence having at least 95% identity to an amino acid sequence of SEQ ID NO:1326.

In one aspect, provided herein is an antibody that binds CD8, comprising: (i) a VH comprising a VH CDR1, a VH CDR2, and a VH CDR3 having an amino acid sequence of SEQ ID NOs:1327, 1328, and 1329, respectively, and (ii) a VL comprising a VL CDR1, VL CDR2, and VL CDR3 having an amino acid sequence of SEQ ID NOs:1330, 1331, and 1332, respectively. In one aspect, provided herein is an antibody that binds CD8, comprising: (i) a VH comprising a VH CDR1, a VH CDR2, and a VH CDR3 having an amino acid sequence of SEQ ID NOs:1333, 1334, and 1335, respectively, and (ii) a VL comprising a VL CDR1, VL CDR2, and VL CDR3 having an amino acid sequence of SEQ ID NOs:1336, 1337, and 1338, respectively. In one aspect, provided herein is an antibody that binds CD8, comprising: (i) a VH comprising a VH CDR1, a VH CDR2, and a VH CDR3 having an amino acid sequence of SEQ ID NOs:1339, 1340, and 1341, respectively, and (ii) a VL comprising a VL CDR1, VL CDR2, and VL CDR3 having an amino acid sequence of SEQ ID NOs:1342, 1343, and 1344, respectively. In one aspect, provided herein is an antibody that binds CD8, comprising: (i) a VH comprising a VH CDR1, a VH CDR2, and a VH CDR3 having an amino acid sequence of SEQ ID NOs:1345, 1346, and 1347, respectively, and (ii) a VL comprising a VL CDR1, VL CDR2, and VL CDR3 having an amino acid sequence of SEQ ID NOs:1348, 1349, and 1350, respectively. In one aspect, provided herein is an antibody that binds CD8, comprising: (i) a VH comprising a VH CDR1, a VH CDR2, and a VH CDR3 having an amino acid sequence of SEQ ID NOs:1351, 1352, and 1353, respectively, and (ii) a VL comprising a VL CDR1, VL CDR2, and VL CDR3 having an amino acid sequence of SEQ ID NOs:1354, 1355, and 1356, respectively. In one aspect, provided herein is an antibody that binds CD8, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1357; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1358. In one aspect, provided herein is an antibody that binds CD8, comprising a VH having an amino acid sequence of SEQ ID NO:1357. In one aspect, provided herein is an antibody that binds CD8, comprising a VL having an amino acid sequence of SEQ ID NO:1358. In one aspect, provided herein is an antibody that binds CD8, comprising a VH having an amino acid sequence of SEQ ID NO:1357, and a VL having an amino acid sequence of SEQ ID NO:1358. In one aspect, provided herein is an antibody that binds CD8, comprising a heavy chain having an amino acid sequence of SEQ ID NO:1359. In one aspect, provided herein is an antibody that binds CD8, comprising a light chain having an amino acid sequence of SEQ ID NO:1360. In one aspect, provided herein is an antibody that binds CD8, comprising a heavy chain having an amino acid sequence of SEQ ID NO:1359, and a light chain having an amino acid sequence of SEQ ID NO:1360. In one aspect, provided herein is an antibody that binds CD8, comprising a VH having an amino acid sequence having at least 95% identity to an amino acid sequence of SEQ ID NO:1357. In one aspect, provided herein is an antibody that binds CD8, comprising a VL having an amino acid sequence having at least 95% identity to an amino acid sequence of SEQ ID NO:1358. In one aspect, provided herein is an antibody that binds CD8, comprising a VH having an amino acid sequence having at least 95% identity to an amino acid sequence of SEQ ID NO:1357, and a VL having an amino acid sequence having at least 95% identity to an amino acid sequence of SEQ ID NO:1358. In one aspect, provided herein is an antibody that binds CD8, comprising a heavy chain having an amino acid sequence having at least 95% identity to an amino acid sequence of SEQ ID NO:1359. In one aspect, provided herein is an antibody that binds CD8, comprising a light chain having an amino acid sequence having at least 95% identity to an amino acid sequence of SEQ ID NO:1360. In one aspect, provided herein is an antibody that binds CD8, comprising a heavy chain having an amino acid sequence having at least 95% identity to an amino acid sequence of SEQ ID NO:1359, and a light chain having an amino acid sequence having at least 95% identity to an amino acid sequence of SEQ ID NO:1360.

In one aspect, provided herein is an antibody that binds CD8, comprising: (i) a VH comprising a VH CDR1, a VH CDR2, and a VH CDR3 having an amino acid sequence of SEQ ID NOs:1361, 1362, and 1363, respectively, and (ii) a VL comprising a VL CDR1, VL CDR2, and VL CDR3 having an amino acid sequence of SEQ ID NOs:1364, 1365, and 1366, respectively. In one aspect, provided herein is an antibody that binds CD8, comprising: (i) a VH comprising a VH CDR1, a VH CDR2, and a VH CDR3 having an amino acid sequence of SEQ ID NOs:1367, 1368, and 1369, respectively, and (ii) a VL comprising a VL CDR1, VL CDR2, and VL CDR3 having an amino acid sequence of SEQ ID NOs:1370, 1371, and 1372, respectively. In one aspect, provided herein is an antibody that binds CD8, comprising: (i) a VH comprising a VH CDR1, a VH CDR2, and a VH CDR3 having an amino acid sequence of SEQ ID NOs:1373, 1374, and 1375, respectively, and (ii) a VL comprising a VL CDR1, VL CDR2, and VL CDR3 having an amino acid sequence of SEQ ID NOs:1376, 1377, and 1378, respectively. In one aspect, provided herein is an antibody that binds CD8, comprising: (i) a VH comprising a VH CDR1, a VH CDR2, and a VH CDR3 having an amino acid sequence of SEQ ID NOs:1379, 1380, and 1381, respectively, and (ii) a VL comprising a VL CDR1, VL CDR2, and VL CDR3 having an amino acid sequence of SEQ ID NOs:1382, 1383, and 1384, respectively. In one aspect, provided herein is an antibody that binds CD8, comprising: (i) a VH comprising a VH CDR1, a VH CDR2, and a VH CDR3 having an amino acid sequence of SEQ ID NOs:1385, 1386, and 1387, respectively, and (ii) a VL comprising a VL CDR1, VL CDR2, and VL CDR3 having an amino acid sequence of SEQ ID NOs:1388, 1389, and 1390, respectively. In one aspect, provided herein is an antibody that binds CD8, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1391; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1392. In one aspect, provided herein is an antibody that binds CD8, comprising a VH having an amino acid sequence of SEQ ID NO:1391. In one aspect, provided herein is an antibody that binds CD8, comprising a VL having an amino acid sequence of SEQ ID NO:1392. In one aspect, provided herein is an antibody that binds CD8, comprising a VH having an amino acid sequence of SEQ ID NO:1391, and a VL having an amino acid sequence of SEQ ID NO:1392. In one aspect, provided herein is an antibody that binds CD8, comprising a heavy chain having an amino acid sequence of SEQ ID NO:1393. In one aspect, provided herein is an antibody that binds CD8, comprising a light chain having an amino acid sequence of SEQ ID NO:1394. In one aspect, provided herein is an antibody that binds CD8, comprising a heavy chain having an amino acid sequence of SEQ ID NO:1393, and a light chain having an amino acid sequence of SEQ ID NO:1394. In one aspect, provided herein is an antibody that binds CD8, comprising a VH having an amino acid sequence having at least 95% identity to an amino acid sequence of SEQ ID NO:1391. In one aspect, provided herein is an antibody that binds CD8, comprising a VL having an amino acid sequence having at least 95% identity to an amino acid sequence of SEQ ID NO:1392. In one aspect, provided herein is an antibody that binds CD8, comprising a VH having an amino acid sequence having at least 95% identity to an amino acid sequence of SEQ ID NO:1391, and a VL having an amino acid sequence having at least 95% identity to an amino acid sequence of SEQ ID NO:1392. In one aspect, provided herein is an antibody that binds CD8, comprising a heavy chain having an amino acid sequence having at least 95% identity to an amino acid sequence of SEQ ID NO:1393. In one aspect, provided herein is an antibody that binds CD8, comprising a light chain having an amino acid sequence having at least 95% identity to an amino acid sequence of SEQ ID NO:1394. In one aspect, provided herein is an antibody that binds CD8, comprising a heavy chain having an amino acid sequence having at least 95% identity to an amino acid sequence of SEQ ID NO:1393, and a light chain having an amino acid sequence having at least 95% identity to an amino acid sequence of SEQ ID NO:1394.

In one aspect, provided herein is an antibody that binds CD8, comprising: (i) a VH comprising a VH CDR1, a VH CDR2, and a VH CDR3 having an amino acid sequence of SEQ ID NOs:1395, 1396, and 1397, respectively, and (ii) a VL comprising a VL CDR1, VL CDR2, and VL CDR3 having an amino acid sequence of SEQ ID NOs:1398, 1399, and 1400, respectively. In one aspect, provided herein is an antibody that binds CD8, comprising: (i) a VH comprising a VH CDR1, a VH CDR2, and a VH CDR3 having an amino acid sequence of SEQ ID NOs:1401, 1402, and 1403, respectively, and (ii) a VL comprising a VL CDR1, VL CDR2, and VL CDR3 having an amino acid sequence of SEQ ID NOs:1404, 1405, and 1406, respectively. In one aspect, provided herein is an antibody that binds CD8, comprising: (i) a VH comprising a VH CDR1, a VH CDR2, and a VH CDR3 having an amino acid sequence of SEQ ID NOs:1407, 1408, and 1409, respectively, and (ii) a VL comprising a VL CDR1, VL CDR2, and VL CDR3 having an amino acid sequence of SEQ ID NOs:1410, 1411, and 1412, respectively. In one aspect, provided herein is an antibody that binds CD8, comprising: (i) a VH comprising a VH CDR1, a VH CDR2, and a VH CDR3 having an amino acid sequence of SEQ ID NOs:1413, 1414, and 1415, respectively, and (ii) a VL comprising a VL CDR1, VL CDR2, and VL CDR3 having an amino acid sequence of SEQ ID NOs:1416, 1417, and 1418, respectively. In one aspect, provided herein is an antibody that binds CD8, comprising: (i) a VH comprising a VH CDR1, a VH CDR2, and a VH CDR3 having an amino acid sequence of SEQ ID NOs:1419, 1420, and 1421, respectively, and (ii) a VL comprising a VL CDR1, VL CDR2, and VL CDR3 having an amino acid sequence of SEQ ID NOs:1422, 1423, and 1424, respectively. In one aspect, provided herein is an antibody that binds CD8, comprising: (i) a VH comprising a VH CDR1, a VH CDR2, and a VH CDR3, respectively, of a VH having an amino acid sequence of SEQ ID NO:1425; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1426. In one aspect, provided herein is an antibody that binds CD8, comprising a VH having an amino acid sequence of SEQ ID NO:1425. In one aspect, provided herein is an antibody that binds CD8, comprising a VL having an amino acid sequence of SEQ ID NO:1426. In one aspect, provided herein is an antibody that binds CD8, comprising a VH having an amino acid sequence of SEQ ID NO:1425, and a VL having an amino acid sequence of SEQ ID NO:1426. In one aspect, provided herein is an antibody that binds CD8, comprising a heavy chain having an amino acid sequence of SEQ ID NO:1427. In one aspect, provided herein is an antibody that binds CD8, comprising a light chain having an amino acid sequence of SEQ ID NO:1428. In one aspect, provided herein is an antibody that binds CD8, comprising a heavy chain having an amino acid sequence of SEQ ID NO:1427, and a light chain having an amino acid sequence of SEQ ID NO:1428. In one aspect, provided herein is an antibody that binds CD8, comprising a VH having an amino acid sequence having at least 95% identity to an amino acid sequence of SEQ ID NO:1425. In one aspect, provided herein is an antibody that binds CD8, comprising a VL having an amino acid sequence having at least 95% identity to an amino acid sequence of SEQ ID NO:1426. In one aspect, provided herein is an antibody that binds CD8, comprising a VH having an amino acid sequence having at least 95% identity to an amino acid sequence of SEQ ID NO:1425, and a VL having an amino acid sequence having at least 95% identity to an amino acid sequence of SEQ ID NO:1426. In one aspect, provided herein is an antibody that binds CD8, comprising a heavy chain having an amino acid sequence having at least 95% identity to an amino acid sequence of SEQ ID NO:1427. In one aspect, provided herein is an antibody that binds CD8, comprising a light chain having an amino acid sequence having at least 95% identity to an amino acid sequence of SEQ ID NO:1428. In one aspect, provided herein is an antibody that binds CD8, comprising a heavy chain having an amino acid sequence having at least 95% identity to an amino acid sequence of SEQ ID NO:1427, and a light chain having an amino acid sequence having at least 95% identity to an amino acid sequence of SEQ ID NO:1428.

In one aspect, provided herein is an antibody that binds CD8, comprising: (i) a VH comprising a VH CDR1, a VH CDR2, and a VH CDR3 having an amino acid sequence of SEQ ID NOs:1429, 1430, and 1431, respectively, and (ii) a VL comprising a VL CDR1, VL CDR2, and VL CDR3 having an amino acid sequence of SEQ ID NOs:1432, 1433, and 1434, respectively. In one aspect, provided herein is an antibody that binds CD8, comprising: (i) a VH comprising a VH CDR1, a VH CDR2, and a VH CDR3 having an amino acid sequence of SEQ ID NOs:1435, 1436, and 1437, respectively, and (ii) a VL comprising a VL CDR1, VL CDR2, and VL CDR3 having an amino acid sequence of SEQ ID NOs:1438, 1439, and 1440, respectively. In one aspect, provided herein is an antibody that binds CD8, comprising: (i) a VH comprising a VH CDR1, a VH CDR2, and a VH CDR3 having an amino acid sequence of SEQ ID NOs:1441, 1442, and 1443, respectively, and (ii) a VL comprising a VL CDR1, VL CDR2, and VL CDR3 having an amino acid sequence of SEQ ID NOs:1444, 1445, and 1446, respectively. In one aspect, provided herein is an antibody that binds CD8, comprising: (i) a VH comprising a VH CDR1, a VH CDR2, and a VH CDR3 having an amino acid sequence of SEQ ID NOs:1447, 1448, and 1449, respectively, and (ii) a VL comprising a VL CDR1, VL CDR2, and VL CDR3 having an amino acid sequence of SEQ ID NOs:1450, 1451, and 1452, respectively. In one aspect, provided herein is an antibody that binds CD8, comprising: (i) a VH comprising a VH CDR1, a VH CDR2, and a VH CDR3 having an amino acid sequence of SEQ ID NOs:1453, 1454, and 1455, respectively, and (ii) a VL comprising a VL CDR1, VL CDR2, and VL CDR3 having an amino acid sequence of SEQ ID NOs:1456, 1457, and 1458, respectively. In one aspect, provided herein is an antibody that binds CD8, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1459; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1460. In one aspect, provided herein is an antibody that binds CD8, comprising a VH having an amino acid sequence of SEQ ID NO:1459. In one aspect, provided herein is an antibody that binds CD8, comprising a VL having an amino acid sequence of SEQ ID NO:1460. In one aspect, provided herein is an antibody that binds CD8, comprising a VH having an amino acid sequence of SEQ ID NO:1459, and a VL having an amino acid sequence of SEQ ID NO:1460. In one aspect, provided herein is an antibody that binds CD8, comprising a heavy chain having an amino acid sequence of SEQ ID NO:1461. In one aspect, provided herein is an antibody that binds CD8, comprising a light chain having an amino acid sequence of SEQ ID NO:1462. In one aspect, provided herein is an antibody that binds CD8, comprising a heavy chain having an amino acid sequence of SEQ ID NO:1461, and a light chain having an amino acid sequence of SEQ ID NO:1462. In one aspect, provided herein is an antibody that binds CD8, comprising a VH having an amino acid sequence having at least 95% identity to an amino acid sequence of SEQ ID NO:1459. In one aspect, provided herein is an antibody that binds CD8, comprising a VL having an amino acid sequence having at least 95% identity to an amino acid sequence of SEQ ID NO:1460. In one aspect, provided herein is an antibody that binds CD8, comprising a VH having an amino acid sequence having at least 95% identity to an amino acid sequence of SEQ ID NO:1459, and a VL having an amino acid sequence having at least 95% identity to an amino acid sequence of SEQ ID NO:1460. In one aspect, provided herein is an antibody that binds CD8, comprising a heavy chain having an amino acid sequence having at least 95% identity to an amino acid sequence of SEQ ID NO:1461. In one aspect, provided herein is an antibody that binds CD8, comprising a light chain having an amino acid sequence having at least 95% identity to an amino acid sequence of SEQ ID NO:1462. In one aspect, provided herein is an antibody that binds CD8, comprising a heavy chain having an amino acid sequence having at least 95% identity to an amino acid sequence of SEQ ID NO:1461, and a light chain having an amino acid sequence having at least 95% identity to an amino acid sequence of SEQ ID NO:1462.

In one aspect, provided herein is an antibody that binds CD8, comprising: (i) a VH comprising a VH CDR1, a VH CDR2, and a VH CDR3 having an amino acid sequence of SEQ ID NOs:1463, 1464, and 1465, respectively, and (ii) a VL comprising a VL CDR1, VL CDR2, and VL CDR3 having an amino acid sequence of SEQ ID NOs:1466, 1467, and 1468, respectively. In one aspect, provided herein is an antibody that binds CD8, comprising: (i) a VH comprising a VH CDR1, a VH CDR2, and a VH CDR3 having an amino acid sequence of SEQ ID NOs:1469, 1470, and 1471, respectively, and (ii) a VL comprising a VL CDR1, VL CDR2, and VL CDR3 having an amino acid sequence of SEQ ID NOs:1472, 1473, and 1474, respectively. In one aspect, provided herein is an antibody that binds CD8, comprising: (i) a VH comprising a VH CDR1, a VH CDR2, and a VH CDR3 having an amino acid sequence of SEQ ID NOs:1475, 1476, and 1477, respectively, and (ii) a VL comprising a VL CDR1, VL CDR2, and VL CDR3 having an amino acid sequence of SEQ ID NOs:1478, 1479, and 1480, respectively. In one aspect, provided herein is an antibody that binds CD8, comprising: (i) a VH comprising a VH CDR1, a VH CDR2, and a VH CDR3 having an amino acid sequence of SEQ ID NOs:1481, 1482, and 1483, respectively, and (ii) a VL comprising a VL CDR1, VL CDR2, and VL CDR3 having an amino acid sequence of SEQ ID NOs:1484, 1485, and 1486, respectively. In one aspect, provided herein is an antibody that binds CD8, comprising: (i) a VH comprising a VH CDR1, a VH CDR2, and a VH CDR3 having an amino acid sequence of SEQ ID NOs:1487, 1488, and 1489, respectively, and (ii) a VL comprising a VL CDR1, VL CDR2, and VL CDR3 having an amino acid sequence of SEQ ID NOs:1490, 1491, and 1492, respectively. In one aspect, provided herein is an antibody that binds CD8, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1493; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1494. In one aspect, provided herein is an antibody that binds CD8, comprising a VH having an amino acid sequence of SEQ ID NO:1493. In one aspect, provided herein is an antibody that binds CD8, comprising a VL having an amino acid sequence of SEQ ID NO:1494. In one aspect, provided herein is an antibody that binds CD8, comprising a VH having an amino acid sequence of SEQ ID NO:1493, and a VL having an amino acid sequence of SEQ ID NO:1494. In one aspect, provided herein is an antibody that binds CD8, comprising a heavy chain having an amino acid sequence of SEQ ID NO:1495. In one aspect, provided herein is an antibody that binds CD8, comprising a light chain having an amino acid sequence of SEQ ID NO:1496. In one aspect, provided herein is an antibody that binds CD8, comprising a heavy chain having an amino acid sequence of SEQ ID NO:1495, and a light chain having an amino acid sequence of SEQ ID NO:1496. In one aspect, provided herein is an antibody that binds CD8, comprising a VH having an amino acid sequence having at least 95% identity to an amino acid sequence of SEQ ID NO:1493. In one aspect, provided herein is an antibody that binds CD8, comprising a VL having an amino acid sequence having at least 95% identity to an amino acid sequence of SEQ ID NO:1494. In one aspect, provided herein is an antibody that binds CD8, comprising a VH having an amino acid sequence having at least 95% identity to an amino acid sequence of SEQ ID NO:1493, and a VL having an amino acid sequence having at least 95% identity to an amino acid sequence of SEQ ID NO:1494. In one aspect, provided herein is an antibody that binds CD8, comprising a heavy chain having an amino acid sequence having at least 95% identity to an amino acid sequence of SEQ ID NO:1495. In one aspect, provided herein is an antibody that binds CD8, comprising a light chain having an amino acid sequence having at least 95% identity to an amino acid sequence of SEQ ID NO:1496. In one aspect, provided herein is an antibody that binds CD8, comprising a heavy chain having an amino acid sequence having at least 95% identity to an amino acid sequence of SEQ ID NO:1495, and a light chain having an amino acid sequence having at least 95% identity to an amino acid sequence of SEQ ID NO:1496.

In one aspect, provided herein is an antibody that binds CD8, comprising: (i) a VH comprising a VH CDR1, a VH CDR2, and a VH CDR3 having an amino acid sequence of SEQ ID NOs:1497, 1498, and 1499, respectively, and (ii) a VL comprising a VL CDR1, VL CDR2, and VL CDR3 having an amino acid sequence of SEQ ID NOs:1500, 1501, and 1502, respectively. In one aspect, provided herein is an antibody that binds CD8, comprising: (i) a VH comprising a VH CDR1, a VH CDR2, and a VH CDR3 having an amino acid sequence of SEQ ID NOs:1503, 1504, and 1505, respectively, and (ii) a VL comprising a VL CDR1, VL CDR2, and VL CDR3 having an amino acid sequence of SEQ ID NOs:1506, 1507, and 1508, respectively. In one aspect, provided herein is an antibody that binds CD8, comprising: (i) a VH comprising a VH CDR1, a VH CDR2, and a VH CDR3 having an amino acid sequence of SEQ ID NOs:1509, 1510, and 1511, respectively, and (ii) a VL comprising a VL CDR1, VL CDR2, and VL CDR3 having an amino acid sequence of SEQ ID NOs:1512, 1513, and 1514, respectively. In one aspect, provided herein is an antibody that binds CD8, comprising: (i) a VH comprising a VH CDR1, a VH CDR2, and a VH CDR3 having an amino acid sequence of SEQ ID NOs:1515, 1516, and 1517, respectively, and (ii) a VL comprising a VL CDR1, VL CDR2, and VL CDR3 having an amino acid sequence of SEQ ID NOs:1518, 1519, and 1520, respectively. In one aspect, provided herein is an antibody that binds CD8, comprising: (i) a VH comprising a VH CDR1, a VH CDR2, and a VH CDR3 having an amino acid sequence of SEQ ID NOs:1521, 1522, and 1523, respectively, and (ii) a VL comprising a VL CDR1, VL CDR2, and VL CDR3 having an amino acid sequence of SEQ ID NOs:1524, 1525, and 1526, respectively. In one aspect, provided herein is an antibody that binds CD8, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1527; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1528. In one aspect, provided herein is an antibody that binds CD8, comprising a VH having an amino acid sequence of SEQ ID NO:1527. In one aspect, provided herein is an antibody that binds CD8, comprising a VL having an amino acid sequence of SEQ ID NO:1528. In one aspect, provided herein is an antibody that binds CD8, comprising a VH having an amino acid sequence of SEQ ID NO:1527, and a VL having an amino acid sequence of SEQ ID NO:1528. In one aspect, provided herein is an antibody that binds CD8, comprising a heavy chain having an amino acid sequence of SEQ ID NO:1529. In one aspect, provided herein is an antibody that binds CD8, comprising a light chain having an amino acid sequence of SEQ ID NO:1530. In one aspect, provided herein is an antibody that binds CD8, comprising a heavy chain having an amino acid sequence of SEQ ID NO:1529, and a light chain having an amino acid sequence of SEQ ID NO:1530. In one aspect, provided herein is an antibody that binds CD8, comprising a VH having an amino acid sequence having at least 95% identity to an amino acid sequence of SEQ ID NO:1527. In one aspect, provided herein is an antibody that binds CD8, comprising a VL having an amino acid sequence having at least 95% identity to an amino acid sequence of SEQ ID NO:1528. In one aspect, provided herein is an antibody that binds CD8, comprising a VH having an amino acid sequence having at least 95% identity to an amino acid sequence of SEQ ID NO:1527, and a VL having an amino acid sequence having at least 95% identity to an amino acid sequence of SEQ ID NO:1528. In one aspect, provided herein is an antibody that binds CD8, comprising a heavy chain having an amino acid sequence having at least 95% identity to an amino acid sequence of SEQ ID NO:1529. In one aspect, provided herein is an antibody that binds CD8, comprising a light chain having an amino acid sequence having at least 95% identity to an amino acid sequence of SEQ ID NO:1530. In one aspect, provided herein is an antibody that binds CD8, comprising a heavy chain having an amino acid sequence having at least 95% identity to an amino acid sequence of SEQ ID NO:1529, and a light chain having an amino acid sequence having at least 95% identity to an amino acid sequence of SEQ ID NO:1530.

In one aspect, provided herein is an antibody that binds CD8, comprising: (i) a VH comprising a VH CDR1, a VH CDR2, and a VH CDR3 having an amino acid sequence of SEQ ID NOs:1531, 1532, and 1533, respectively, and (ii) a VL comprising a VL CDR1, VL CDR2, and VL CDR3 having an amino acid sequence of SEQ ID NOs:1534, 1535, and 1536, respectively. In one aspect, provided herein is an antibody that binds CD8, comprising: (i) a VH comprising a VH CDR1, a VH CDR2, and a VH CDR3 having an amino acid sequence of SEQ ID NOs:1537, 1538, and 1539, respectively, and (ii) a VL comprising a VL CDR1, VL CDR2, and VL CDR3 having an amino acid sequence of SEQ ID NOs:1540, 1541, and 1542, respectively. In one aspect, provided herein is an antibody that binds CD8, comprising: (i) a VH comprising a VH CDR1, a VH CDR2, and a VH CDR3 having an amino acid sequence of SEQ ID NOs:1543, 1544, and 1545, respectively, and (ii) a VL comprising a VL CDR1, VL CDR2, and VL CDR3 having an amino acid sequence of SEQ ID NOs:1546, 1547, and 1548, respectively. In one aspect, provided herein is an antibody that binds CD8, comprising: (i) a VH comprising a VH CDR1, a VH CDR2, and a VH CDR3 having an amino acid sequence of SEQ ID NOs:1549, 1550, and 1551, respectively, and (ii) a VL comprising a VL CDR1, VL CDR2, and VL CDR3 having an amino acid sequence of SEQ ID NOs:1552, 1553, and 1554, respectively. In one aspect, provided herein is an antibody that binds CD8, comprising: (i) a VH comprising a VH CDR1, a VH CDR2, and a VH CDR3 having an amino acid sequence of SEQ ID NOs:1555, 1556, and 1557, respectively, and (ii) a VL comprising a VL CDR1, VL CDR2, and VL CDR3 having an amino acid sequence of SEQ ID NOs:1558, 1559, and 1560, respectively. In one aspect, provided herein is an antibody that binds CD8, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1561; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1562. In one aspect, provided herein is an antibody that binds CD8, comprising a VH having an amino acid sequence of SEQ ID NO:1561. In one aspect, provided herein is an antibody that binds CD8, comprising a VL having an amino acid sequence of SEQ ID NO:1562. In one aspect, provided herein is an antibody that binds CD8, comprising a VH having an amino acid sequence of SEQ ID NO:1561, and a VL having an amino acid sequence of SEQ ID NO:1562. In one aspect, provided herein is an antibody that binds CD8, comprising a heavy chain having an amino acid sequence of SEQ ID NO:1563. In one aspect, provided herein is an antibody that binds CD8, comprising a light chain having an amino acid sequence of SEQ ID NO:1564. In one aspect, provided herein is an antibody that binds CD8, comprising a heavy chain having an amino acid sequence of SEQ ID NO:1563, and a light chain having an amino acid sequence of SEQ ID NO:1564. In one aspect, provided herein is an antibody that binds CD8, comprising a VH having an amino acid sequence having at least 95% identity to an amino acid sequence of SEQ ID NO:1561. In one aspect, provided herein is an antibody that binds CD8, comprising a VL having an amino acid sequence having at least 95% identity to an amino acid sequence of SEQ ID NO:1562. In one aspect, provided herein is an antibody that binds CD8, comprising a VH having an amino acid sequence having at least 95% identity to an amino acid sequence of SEQ ID NO:1561, and a VL having an amino acid sequence having at least 95% identity to an amino acid sequence of SEQ ID NO:1562. In one aspect, provided herein is an antibody that binds CD8, comprising a heavy chain having an amino acid sequence having at least 95% identity to an amino acid sequence of SEQ ID NO:1563. In one aspect, provided herein is an antibody that binds CD8, comprising a light chain having an amino acid sequence having at least 95% identity to an amino acid sequence of SEQ ID NO:1564. In one aspect, provided herein is an antibody that binds CD8, comprising a heavy chain having an amino acid sequence having at least 95% identity to an amino acid sequence of SEQ ID NO:1563, and a light chain having an amino acid sequence having at least 95% identity to an amino acid sequence of SEQ ID NO:1564.

In one aspect, provided herein is an antibody that binds CD8, comprising: (i) a VH comprising a VH CDR1, a VH CDR2, and a VH CDR3 having an amino acid sequence of SEQ ID NOs:1565, 1566, and 1567, respectively, and (ii) a VL comprising a VL CDR1, VL CDR2, and VL CDR3 having an amino acid sequence of SEQ ID NOs:1568, 1569, and 1570, respectively. In one aspect, provided herein is an antibody that binds CD8, comprising: (i) a VH comprising a VH CDR1, a VH CDR2, and a VH CDR3 having an amino acid sequence of SEQ ID NOs:1571, 1572, and 1573, respectively, and (ii) a VL comprising a VL CDR1, VL CDR2, and VL CDR3 having an amino acid sequence of SEQ ID NOs:1574, 1575, and 1576, respectively. In one aspect, provided herein is an antibody that binds CD8, comprising: (i) a VH comprising a VH CDR1, a VH CDR2, and a VH CDR3 having an amino acid sequence of SEQ ID NOs:1577, 1578, and 1579, respectively, and (ii) a VL comprising a VL CDR1, VL CDR2, and VL CDR3 having an amino acid sequence of SEQ ID NOs:1580, 1581, and 1582, respectively. In one aspect, provided herein is an antibody that binds CD8, comprising: (i) a VH comprising a VH CDR1, a VH CDR2, and a VH CDR3 having an amino acid sequence of SEQ ID NOs:1583, 1584, and 1585, respectively, and (ii) a VL comprising a VL CDR1, VL CDR2, and VL CDR3 having an amino acid sequence of SEQ ID NOs:1586, 1587, and 1588, respectively. In one aspect, provided herein is an antibody that binds CD8, comprising: (i) a VH comprising a VH CDR1, a VH CDR2, and a VH CDR3 having an amino acid sequence of SEQ ID NOs:1589, 1590, and 1591, respectively, and (ii) a VL comprising a VL CDR1, VL CDR2, and VL CDR3 having an amino acid sequence of SEQ ID NOs:1592, 1593, and 1594, respectively. In one aspect, provided herein is an antibody that binds CD8, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1595; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1596. In one aspect, provided herein is an antibody that binds CD8, comprising a VH having an amino acid sequence of SEQ ID NO:1595. In one aspect, provided herein is an antibody that binds CD8, comprising a VL having an amino acid sequence of SEQ ID NO:1596. In one aspect, provided herein is an antibody that binds CD8, comprising a VH having an amino acid sequence of SEQ ID NO:1595, and a VL having an amino acid sequence of SEQ ID NO:1596. In one aspect, provided herein is an antibody that binds CD8, comprising a heavy chain having an amino acid sequence of SEQ ID NO:1597. In one aspect, provided herein is an antibody that binds CD8, comprising a light chain having an amino acid sequence of SEQ ID NO:1598. In one aspect, provided herein is an antibody that binds CD8, comprising a heavy chain having an amino acid sequence of SEQ ID NO:1597, and a light chain having an amino acid sequence of SEQ ID NO:1598. In one aspect, provided herein is an antibody that binds CD8, comprising a VH having an amino acid sequence having at least 95% identity to an amino acid sequence of SEQ ID NO:1595. In one aspect, provided herein is an antibody that binds CD8, comprising a VL having an amino acid sequence having at least 95% identity to an amino acid sequence of SEQ ID NO:1596. In one aspect, provided herein is an antibody that binds CD8, comprising a VH having an amino acid sequence having at least 95% identity to an amino acid sequence of SEQ ID NO:1595, and a VL having an amino acid sequence having at least 95% identity to an amino acid sequence of SEQ ID NO:1596. In one aspect, provided herein is an antibody that binds CD8, comprising a heavy chain having an amino acid sequence having at least 95% identity to an amino acid sequence of SEQ ID NO:1597. In one aspect, provided herein is an antibody that binds CD8, comprising a light chain having an amino acid sequence having at least 95% identity to an amino acid sequence of SEQ ID NO:1598. In one aspect, provided herein is an antibody that binds CD8, comprising a heavy chain having an amino acid sequence having at least 95% identity to an amino acid sequence of SEQ ID NO:1597, and a light chain having an amino acid sequence having at least 95% identity to an amino acid sequence of SEQ ID NO:1598.

In one aspect, provided herein is an antibody that binds CD8, comprising: (i) a VH comprising a VH CDR1, a VH CDR2, and a VH CDR3 having an amino acid sequence of SEQ ID NOs:1599, 1600, and 1601, respectively, and (ii) a VL comprising a VL CDR1, VL CDR2, and VL CDR3 having an amino acid sequence of SEQ ID NOs:1602, 1603, and 1604, respectively. In one aspect, provided herein is an antibody that binds CD8, comprising: (i) a VH comprising a VH CDR1, a VH CDR2, and a VH CDR3 having an amino acid sequence of SEQ ID NOs:1605, 1606, and 1607, respectively, and (ii) a VL comprising a VL CDR1, VL CDR2, and VL CDR3 having an amino acid sequence of SEQ ID NOs:1608, 1609, and 1610, respectively. In one aspect, provided herein is an antibody that binds CD8, comprising: (i) a VH comprising a VH CDR1, a VH CDR2, and a VH CDR3 having an amino acid sequence of SEQ ID NOs:1611, 1612, and 1613, respectively, and (ii) a VL comprising a VL CDR1, VL CDR2, and VL CDR3 having an amino acid sequence of SEQ ID NOs:1614, 1615, and 1616, respectively. In one aspect, provided herein is an antibody that binds CD8, comprising: (i) a VH comprising a VH CDR1, a VH CDR2, and a VH CDR3 having an amino acid sequence of SEQ ID NOs:1617, 1618, and 1619, respectively, and (ii) a VL comprising a VL CDR1, VL CDR2, and VL CDR3 having an amino acid sequence of SEQ ID NOs:1620, 1621, and 1622, respectively. In one aspect, provided herein is an antibody that binds CD8, comprising: (i) a VH comprising a VH CDR1, a VH CDR2, and a VH CDR3 having an amino acid sequence of SEQ ID NOs:1623, 1624, and 1625, respectively, and (ii) a VL comprising a VL CDR1, VL CDR2, and VL CDR3 having an amino acid sequence of SEQ ID NOs:1626, 1627, and 1628, respectively. In one aspect, provided herein is an antibody that binds CD8, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1629; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1630. In one aspect, provided herein is an antibody that binds CD8, comprising a VH having an amino acid sequence of SEQ ID NO:1629. In one aspect, provided herein is an antibody that binds CD8, comprising a VL having an amino acid sequence of SEQ ID NO:1630. In one aspect, provided herein is an antibody that binds CD8, comprising a VH having an amino acid sequence of SEQ ID NO:1629, and a VL having an amino acid sequence of SEQ ID NO:1630. In one aspect, provided herein is an antibody that binds CD8, comprising a heavy chain having an amino acid sequence of SEQ ID NO:1631. In one aspect, provided herein is an antibody that binds CD8, comprising a light chain having an amino acid sequence of SEQ ID NO:1632. In one aspect, provided herein is an antibody that binds CD8, comprising a heavy chain having an amino acid sequence of SEQ ID NO:1631, and a light chain having an amino acid sequence of SEQ ID NO:1632. In one aspect, provided herein is an antibody that binds CD8, comprising a VH having an amino acid sequence having at least 95% identity to an amino acid sequence of SEQ ID NO:1629. In one aspect, provided herein is an antibody that binds CD8, comprising a VL having an amino acid sequence having at least 95% identity to an amino acid sequence of SEQ ID NO:1630. In one aspect, provided herein is an antibody that binds CD8, comprising a VH having an amino acid sequence having at least 95% identity to an amino acid sequence of SEQ ID NO:1629, and a VL having an amino acid sequence having at least 95% identity to an amino acid sequence of SEQ ID NO:1630. In one aspect, provided herein is an antibody that binds CD8, comprising a heavy chain having an amino acid sequence having at least 95% identity to an amino acid sequence of SEQ ID NO:1631. In one aspect, provided herein is an antibody that binds CD8, comprising a light chain having an amino acid sequence having at least 95% identity to an amino acid sequence of SEQ ID NO:1632. In one aspect, provided herein is an antibody that binds CD8, comprising a heavy chain having an amino acid sequence having at least 95% identity to an amino acid sequence of SEQ ID NO:1631, and a light chain having an amino acid sequence having at least 95% identity to an amino acid sequence of SEQ ID NO:1632.

In one aspect, provided herein is an antibody that binds CD8, comprising: (i) a VH comprising a VH CDR1, a VH CDR2, and a VH CDR3 having an amino acid sequence of SEQ ID NOs:1633, 1634, and 1635, respectively, and (ii) a VL comprising a VL CDR1, VL CDR2, and VL CDR3 having an amino acid sequence of SEQ ID NOs:1636, 1637, and 1638, respectively. In one aspect, provided herein is an antibody that binds CD8, comprising: (i) a VH comprising a VH CDR1, a VH CDR2, and a VH CDR3 having an amino acid sequence of SEQ ID NOs:1639, 1640, and 1641, respectively, and (ii) a VL comprising a VL CDR1, VL CDR2, and VL CDR3 having an amino acid sequence of SEQ ID NOs:1642, 1643, and 1644, respectively. In one aspect, provided herein is an antibody that binds CD8, comprising: (i) a VH comprising a VH CDR1, a VH CDR2, and a VH CDR3 having an amino acid sequence of SEQ ID NOs:1645, 1646, and 1647, respectively, and (ii) a VL comprising a VL CDR1, VL CDR2, and VL CDR3 having an amino acid sequence of SEQ ID NOs:1648, 1649, and 1650, respectively. In one aspect, provided herein is an antibody that binds CD8, comprising: (i) a VH comprising a VH CDR1, a VH CDR2, and a VH CDR3 having an amino acid sequence of SEQ ID NOs:1651, 1652, and 1653, respectively, and (ii) a VL comprising a VL CDR1, VL CDR2, and VL CDR3 having an amino acid sequence of SEQ ID NOs:1654, 1655, and 1656, respectively. In one aspect, provided herein is an antibody that binds CD8, comprising: (i) a VH comprising a VH CDR1, a VH CDR2, and a VH CDR3 having an amino acid sequence of SEQ ID NOs:1657, 1658, and 1659, respectively, and (ii) a VL comprising a VL CDR1, VL CDR2, and VL CDR3 having an amino acid sequence of SEQ ID NOs:1660, 1661, and 1662, respectively. In one aspect, provided herein is an antibody that binds CD8, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1663; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1664. In one aspect, provided herein is an antibody that binds CD8, comprising a VH having an amino acid sequence of SEQ ID NO:1663. In one aspect, provided herein is an antibody that binds CD8, comprising a VL having an amino acid sequence of SEQ ID NO:1664. In one aspect, provided herein is an antibody that binds CD8, comprising a VH having an amino acid sequence of SEQ ID NO:1663, and a VL having an amino acid sequence of SEQ ID NO:1664. In one aspect, provided herein is an antibody that binds CD8, comprising a heavy chain having an amino acid sequence of SEQ ID NO:1665. In one aspect, provided herein is an antibody that binds CD8, comprising a light chain having an amino acid sequence of SEQ ID NO:1666. In one aspect, provided herein is an antibody that binds CD8, comprising a heavy chain having an amino acid sequence of SEQ ID NO:1665, and a light chain having an amino acid sequence of SEQ ID NO:1666. In one aspect, provided herein is an antibody that binds CD8, comprising a VH having an amino acid sequence having at least 95% identity to an amino acid sequence of SEQ ID NO:1663. In one aspect, provided herein is an antibody that binds CD8, comprising a VL having an amino acid sequence having at least 95% identity to an amino acid sequence of SEQ ID NO:1664. In one aspect, provided herein is an antibody that binds CD8, comprising a VH having an amino acid sequence having at least 95% identity to an amino acid sequence of SEQ ID NO:1663, and a VL having an amino acid sequence having at least 95% identity to an amino acid sequence of SEQ ID NO:1664. In one aspect, provided herein is an antibody that binds CD8, comprising a heavy chain having an amino acid sequence having at least 95% identity to an amino acid sequence of SEQ ID NO:1665. In one aspect, provided herein is an antibody that binds CD8, comprising a light chain having an amino acid sequence having at least 95% identity to an amino acid sequence of SEQ ID NO:1666. In one aspect, provided herein is an antibody that binds CD8, comprising a heavy chain having an amino acid sequence having at least 95% identity to an amino acid sequence of SEQ ID NO:1665, and a light chain having an amino acid sequence having at least 95% identity to an amino acid sequence of SEQ ID NO:1666.

In one aspect, provided herein is an antibody that binds CD8, comprising: (i) a VH comprising a VH CDR1, a VH CDR2, and a VH CDR3 having an amino acid sequence of SEQ ID NOs:1667, 1668, and 1669, respectively, and (ii) a VL comprising a VL CDR1, VL CDR2, and VL CDR3 having an amino acid sequence of SEQ ID NOs:1670, 1671, and 1672, respectively. In one aspect, provided herein is an antibody that binds CD8, comprising: (i) a VH comprising a VH CDR1, a VH CDR2, and a VH CDR3 having an amino acid sequence of SEQ ID NOs:1673, 1674, and 1675, respectively, and (ii) a VL comprising a VL CDR1, VL CDR2, and VL CDR3 having an amino acid sequence of SEQ ID NOs:1676, 1677, and 1678, respectively. In one aspect, provided herein is an antibody that binds CD8, comprising: (i) a VH comprising a VH CDR1, a VH CDR2, and a VH CDR3 having an amino acid sequence of SEQ ID NOs:1679, 1680, and 1681, respectively, and (ii) a VL comprising a VL CDR1, VL CDR2, and VL CDR3 having an amino acid sequence of SEQ ID NOs:1682, 1683, and 1684, respectively. In one aspect, provided herein is an antibody that binds CD8, comprising: (i) a VH comprising a VH CDR1, a VH CDR2, and a VH CDR3 having an amino acid sequence of SEQ ID NOs:1685, 1686, and 1687, respectively, and (ii) a VL comprising a VL CDR1, VL CDR2, and VL CDR3 having an amino acid sequence of SEQ ID NOs:1688, 1689, and 1690, respectively. In one aspect, provided herein is an antibody that binds CD8, comprising: (i) a VH comprising a VH CDR1, a VH CDR2, and a VH CDR3 having an amino acid sequence of SEQ ID NOs:1691, 1692, and 1693, respectively, and (ii) a VL comprising a VL CDR1, VL CDR2, and VL CDR3 having an amino acid sequence of SEQ ID NOs:1694, 1695, and 1696, respectively. In one aspect, provided herein is an antibody that binds CD8, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1697; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1698. In one aspect, provided herein is an antibody that binds CD8, comprising a VH having an amino acid sequence of SEQ ID NO:1697. In one aspect, provided herein is an antibody that binds CD8, comprising a VL having an amino acid sequence of SEQ ID NO:1698. In one aspect, provided herein is an antibody that binds CD8, comprising a VH having an amino acid sequence of SEQ ID NO:1697, and a VL having an amino acid sequence of SEQ ID NO:1698. In one aspect, provided herein is an antibody that binds CD8, comprising a heavy chain having an amino acid sequence of SEQ ID NO:1699. In one aspect, provided herein is an antibody that binds CD8, comprising a light chain having an amino acid sequence of SEQ ID NO:1700. In one aspect, provided herein is an antibody that binds CD8, comprising a heavy chain having an amino acid sequence of SEQ ID NO:1699, and a light chain having an amino acid sequence of SEQ ID NO:1700. In one aspect, provided herein is an antibody that binds CD8, comprising a VH having an amino acid sequence having at least 95% identity to an amino acid sequence of SEQ ID NO:1697. In one aspect, provided herein is an antibody that binds CD8, comprising a VL having an amino acid sequence having at least 95% identity to an amino acid sequence of SEQ ID NO:1698. In one aspect, provided herein is an antibody that binds CD8, comprising a VH having an amino acid sequence having at least 95% identity to an amino acid sequence of SEQ ID NO:1697, and a VL having an amino acid sequence having at least 95% identity to an amino acid sequence of SEQ ID NO:1698. In one aspect, provided herein is an antibody that binds CD8, comprising a heavy chain having an amino acid sequence having at least 95% identity to an amino acid sequence of SEQ ID NO:1699. In one aspect, provided herein is an antibody that binds CD8, comprising a light chain having an amino acid sequence having at least 95% identity to an amino acid sequence of SEQ ID NO:1700. In one aspect, provided herein is an antibody that binds CD8, comprising a heavy chain having an amino acid sequence having at least 95% identity to an amino acid sequence of SEQ ID NO:1699, and a light chain having an amino acid sequence having at least 95% identity to an amino acid sequence of SEQ ID NO:1700.

In one aspect, provided herein is an antibody that binds CD8, comprising: (i) a VH comprising a VH CDR1, a VH CDR2, and a VH CDR3 having an amino acid sequence of SEQ ID NOs:1701, 1702, and 1703, respectively, and (ii) a VL comprising a VL CDR1, VL CDR2, and VL CDR3 having an amino acid sequence of SEQ ID NOs:1704, 1705, and 1706, respectively. In one aspect, provided herein is an antibody that binds CD8, comprising: (i) a VH comprising a VH CDR1, a VH CDR2, and a VH CDR3 having an amino acid sequence of SEQ ID NOs:1707, 1708, and 1709, respectively, and (ii) a VL comprising a VL CDR1, VL CDR2, and VL CDR3 having an amino acid sequence of SEQ ID NOs:1710, 1711, and 1712, respectively. In one aspect, provided herein is an antibody that binds CD8, comprising: (i) a VH comprising a VH CDR1, a VH CDR2, and a VH CDR3 having an amino acid sequence of SEQ ID NOs:1713, 1714, and 1715, respectively, and (ii) a VL comprising a VL CDR1, VL CDR2, and VL CDR3 having an amino acid sequence of SEQ ID NOs:1716, 1717, and 1718, respectively. In one aspect, provided herein is an antibody that binds CD8, comprising: (i) a VH comprising a VH CDR1, a VH CDR2, and a VH CDR3 having an amino acid sequence of SEQ ID NOs:1719, 1720, and 1721, respectively, and (ii) a VL comprising a VL CDR1, VL CDR2, and VL CDR3 having an amino acid sequence of SEQ ID NOs:1722, 1723, and 1724, respectively. In one aspect, provided herein is an antibody that binds CD8, comprising: (i) a VH comprising a VH CDR1, a VH CDR2, and a VH CDR3 having an amino acid sequence of SEQ ID NOs:1725, 1726, and 1727, respectively, and (ii) a VL comprising a VL CDR1, VL CDR2, and VL CDR3 having an amino acid sequence of SEQ ID NOs:1728, 1729, and 1730, respectively. In one aspect, provided herein is an antibody that binds CD8, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1731; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1732. In one aspect, provided herein is an antibody that binds CD8, comprising a VH having an amino acid sequence of SEQ ID NO:1731. In one aspect, provided herein is an antibody that binds CD8, comprising a VL having an amino acid sequence of SEQ ID NO:1732. In one aspect, provided herein is an antibody that binds CD8, comprising a VH having an amino acid sequence of SEQ ID NO:1731, and a VL having an amino acid sequence of SEQ ID NO:1732. In one aspect, provided herein is an antibody that binds CD8, comprising a heavy chain having an amino acid sequence of SEQ ID NO:1733. In one aspect, provided herein is an antibody that binds CD8, comprising a light chain having an amino acid sequence of SEQ ID NO:1734. In one aspect, provided herein is an antibody that binds CD8, comprising a heavy chain having an amino acid sequence of SEQ ID NO:1733, and a light chain having an amino acid sequence of SEQ ID NO:1734. In one aspect, provided herein is an antibody that binds CD8, comprising a VH having an amino acid sequence having at least 95% identity to an amino acid sequence of SEQ ID NO:1731. In one aspect, provided herein is an antibody that binds CD8, comprising a VL having an amino acid sequence having at least 95% identity to an amino acid sequence of SEQ ID NO:1732. In one aspect, provided herein is an antibody that binds CD8, comprising a VH having an amino acid sequence having at least 95% identity to an amino acid sequence of SEQ ID NO:1731, and a VL having an amino acid sequence having at least 95% identity to an amino acid sequence of SEQ ID NO:1732. In one aspect, provided herein is an antibody that binds CD8, comprising a heavy chain having an amino acid sequence having at least 95% identity to an amino acid sequence of SEQ ID NO:1733. In one aspect, provided herein is an antibody that binds CD8, comprising a light chain having an amino acid sequence having at least 95% identity to an amino acid sequence of SEQ ID NO:1734. In one aspect, provided herein is an antibody that binds CD8, comprising a heavy chain having an amino acid sequence having at least 95% identity to an amino acid sequence of SEQ ID NO:1733, and a light chain having an amino acid sequence having at least 95% identity to an amino acid sequence of SEQ ID NO:1734.

In one aspect, provided herein is an antibody that binds CD8, comprising: (i) a VH comprising a VH CDR1, a VH CDR2, and a VH CDR3 having an amino acid sequence of SEQ ID NOs:1735, 1736, and 1737, respectively, and (ii) a VL comprising a VL CDR1, VL CDR2, and VL CDR3 having an amino acid sequence of SEQ ID NOs:1738, 1739, and 1740, respectively. In one aspect, provided herein is an antibody that binds CD8, comprising: (i) a VH comprising a VH CDR1, a VH CDR2, and a VH CDR3 having an amino acid sequence of SEQ ID NOs:1741, 1742, and 1743, respectively, and (ii) a VL comprising a VL CDR1, VL CDR2, and VL CDR3 having an amino acid sequence of SEQ ID NOs:1744, 1745, and 1746, respectively. In one aspect, provided herein is an antibody that binds CD8, comprising: (i) a VH comprising a VH CDR1, a VH CDR2, and a VH CDR3 having an amino acid sequence of SEQ ID NOs:1747, 1748, and 1749, respectively, and (ii) a VL comprising a VL CDR1, VL CDR2, and VL CDR3 having an amino acid sequence of SEQ ID NOs:1750, 1751, and 1752, respectively. In one aspect, provided herein is an antibody that binds CD8, comprising: (i) a VH comprising a VH CDR1, a VH CDR2, and a VH CDR3 having an amino acid sequence of SEQ ID NOs:1753, 1754, and 1755, respectively, and (ii) a VL comprising a VL CDR1, VL CDR2, and VL CDR3 having an amino acid sequence of SEQ ID NOs:1756, 1757, and 1758, respectively. In one aspect, provided herein is an antibody that binds CD8, comprising: (i) a VH comprising a VH CDR1, a VH CDR2, and a VH CDR3 having an amino acid sequence of SEQ ID NOs:1759, 1760, and 1761, respectively, and (ii) a VL comprising a VL CDR1, VL CDR2, and VL CDR3 having an amino acid sequence of SEQ ID NOs:1762, 1763, and 1764, respectively. In one aspect, provided herein is an antibody that binds CD8, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1765; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1766. In one aspect, provided herein is an antibody that binds CD8, comprising a VH having an amino acid sequence of SEQ ID NO:1765. In one aspect, provided herein is an antibody that binds CD8, comprising a VL having an amino acid sequence of SEQ ID NO:1766. In one aspect, provided herein is an antibody that binds CD8, comprising a VH having an amino acid sequence of SEQ ID NO:1765, and a VL having an amino acid sequence of SEQ ID NO:1766. In one aspect, provided herein is an antibody that binds CD8, comprising a heavy chain having an amino acid sequence of SEQ ID NO:1767. In one aspect, provided herein is an antibody that binds CD8, comprising a light chain having an amino acid sequence of SEQ ID NO:1768. In one aspect, provided herein is an antibody that binds CD8, comprising a heavy chain having an amino acid sequence of SEQ ID NO:1767, and a light chain having an amino acid sequence of SEQ ID NO:1768. In one aspect, provided herein is an antibody that binds CD8, comprising a VH having an amino acid sequence having at least 95% identity to an amino acid sequence of SEQ ID NO:1765. In one aspect, provided herein is an antibody that binds CD8, comprising a VL having an amino acid sequence having at least 95% identity to an amino acid sequence of SEQ ID NO:1766. In one aspect, provided herein is an antibody that binds CD8, comprising a VH having an amino acid sequence having at least 95% identity to an amino acid sequence of SEQ ID NO:1765, and a VL having an amino acid sequence having at least 95% identity to an amino acid sequence of SEQ ID NO:1766. In one aspect, provided herein is an antibody that binds CD8, comprising a heavy chain having an amino acid sequence having at least 95% identity to an amino acid sequence of SEQ ID NO:1767. In one aspect, provided herein is an antibody that binds CD8, comprising a light chain having an amino acid sequence having at least 95% identity to an amino acid sequence of SEQ ID NO:1768. In one aspect, provided herein is an antibody that binds CD8, comprising a heavy chain having an amino acid sequence having at least 95% identity to an amino acid sequence of SEQ ID NO:1767, and a light chain having an amino acid sequence having at least 95% identity to an amino acid sequence of SEQ ID NO:1768.

In one aspect, provided herein is an antibody that binds CD8, comprising: (i) a VH comprising a VH CDR1, a VH CDR2, and a VH CDR3 having an amino acid sequence of SEQ ID NOs:1769, 1770, and 1771, respectively, and (ii) a VL comprising a VL CDR1, VL CDR2, and VL CDR3 having an amino acid sequence of SEQ ID NOs:1772, 1773, and 1774, respectively. In one aspect, provided herein is an antibody that binds CD8, comprising: (i) a VH comprising a VH CDR1, a VH CDR2, and a VH CDR3 having an amino acid sequence of SEQ ID NOs:1775, 1776, and 1777, respectively, and (ii) a VL comprising a VL CDR1, VL CDR2, and VL CDR3 having an amino acid sequence of SEQ ID NOs:1778, 1779, and 1780, respectively. In one aspect, provided herein is an antibody that binds CD8, comprising: (i) a VH comprising a VH CDR1, a VH CDR2, and a VH CDR3 having an amino acid sequence of SEQ ID NOs:1781, 1782, and 1783, respectively, and (ii) a VL comprising a VL CDR1, VL CDR2, and VL CDR3 having an amino acid sequence of SEQ ID NOs:1784, 1785, and 1786, respectively. In one aspect, provided herein is an antibody that binds CD8, comprising: (i) a VH comprising a VH CDR1, a VH CDR2, and a VH CDR3 having an amino acid sequence of SEQ ID NOs:1787, 1788, and 1789, respectively, and (ii) a VL comprising a VL CDR1, VL CDR2, and VL CDR3 having an amino acid sequence of SEQ ID NOs:1790, 1791, and 1792, respectively. In one aspect, provided herein is an antibody that binds CD8, comprising: (i) a VH comprising a VH CDR1, a VH CDR2, and a VH CDR3 having an amino acid sequence of SEQ ID NOs:1793, 1794, and 1795, respectively, and (ii) a VL comprising a VL CDR1, VL CDR2, and VL CDR3 having an amino acid sequence of SEQ ID NOs:1796, 1797, and 1798, respectively. In one aspect, provided herein is an antibody that binds CD8, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1799; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1800. In one aspect, provided herein is an antibody that binds CD8, comprising a VH having an amino acid sequence of SEQ ID NO:1799. In one aspect, provided herein is an antibody that binds CD8, comprising a VL having an amino acid sequence of SEQ ID NO:1800. In one aspect, provided herein is an antibody that binds CD8, comprising a VH having an amino acid sequence of SEQ ID NO:1799, and a VL having an amino acid sequence of SEQ ID NO:1800. In one aspect, provided herein is an antibody that binds CD8, comprising a heavy chain having an amino acid sequence of SEQ ID NO:1801. In one aspect, provided herein is an antibody that binds CD8, comprising a light chain having an amino acid sequence of SEQ ID NO:1802. In one aspect, provided herein is an antibody that binds CD8, comprising a heavy chain having an amino acid sequence of SEQ ID NO:1801, and a light chain having an amino acid sequence of SEQ ID NO:1802. In one aspect, provided herein is an antibody that binds CD8, comprising a VH having an amino acid sequence having at least 95% identity to an amino acid sequence of SEQ ID NO:1799. In one aspect, provided herein is an antibody that binds CD8, comprising a VL having an amino acid sequence having at least 95% identity to an amino acid sequence of SEQ ID NO:1800. In one aspect, provided herein is an antibody that binds CD8, comprising a VH having an amino acid sequence having at least 95% identity to an amino acid sequence of SEQ ID NO:1799, and a VL having an amino acid sequence having at least 95% identity to an amino acid sequence of SEQ ID NO:1800. In one aspect, provided herein is an antibody that binds CD8, comprising a heavy chain having an amino acid sequence having at least 95% identity to an amino acid sequence of SEQ ID NO:1801. In one aspect, provided herein is an antibody that binds CD8, comprising a light chain having an amino acid sequence having at least 95% identity to an amino acid sequence of SEQ ID NO:1802. In one aspect, provided herein is an antibody that binds CD8, comprising a heavy chain having an amino acid sequence having at least 95% identity to an amino acid sequence of SEQ ID NO:1801, and a light chain having an amino acid sequence having at least 95% identity to an amino acid sequence of SEQ ID NO:1802.

In one aspect, provided herein is an antibody that binds CD8, comprising: (i) a VH comprising a VH CDR1, a VH CDR2, and a VH CDR3 having an amino acid sequence of SEQ ID NOs:1803, 1804, and 1805, respectively, and (ii) a VL comprising a VL CDR1, VL CDR2, and VL CDR3 having an amino acid sequence of SEQ ID NOs:1806, 1807, and 1808, respectively. In one aspect, provided herein is an antibody that binds CD8, comprising: (i) a VH comprising a VH CDR1, a VH CDR2, and a VH CDR3 having an amino acid sequence of SEQ ID NOs:1809, 1810, and 1811, respectively, and (ii) a VL comprising a VL CDR1, VL CDR2, and VL CDR3 having an amino acid sequence of SEQ ID NOs:1812, 1813, and 1814, respectively. In one aspect, provided herein is an antibody that binds CD8, comprising: (i) a VH comprising a VH CDR1, a VH CDR2, and a VH CDR3 having an amino acid sequence of SEQ ID NOs:1815, 1816, and 1817, respectively, and (ii) a VL comprising a VL CDR1, VL CDR2, and VL CDR3 having an amino acid sequence of SEQ ID NOs:1818, 1819, and 1820, respectively. In one aspect, provided herein is an antibody that binds CD8, comprising: (i) a VH comprising a VH CDR1, a VH CDR2, and a VH CDR3 having an amino acid sequence of SEQ ID NOs:1821, 1822, and 1823, respectively, and (ii) a VL comprising a VL CDR1, VL CDR2, and VL CDR3 having an amino acid sequence of SEQ ID NOs:1824, 1825, and 1826, respectively. In one aspect, provided herein is an antibody that binds CD8, comprising: (i) a VH comprising a VH CDR1, a VH CDR2, and a VH CDR3 having an amino acid sequence of SEQ ID NOs:1827, 1828, and 1829, respectively, and (ii) a VL comprising a VL CDR1, VL CDR2, and VL CDR3 having an amino acid sequence of SEQ ID NOs:1830, 1831, and 1832, respectively. In one aspect, provided herein is an antibody that binds CD8, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1833; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1834. In one aspect, provided herein is an antibody that binds CD8, comprising a VH having an amino acid sequence of SEQ ID NO:1833. In one aspect, provided herein is an antibody that binds CD8, comprising a VL having an amino acid sequence of SEQ ID NO:1834. In one aspect, provided herein is an antibody that binds CD8, comprising a VH having an amino acid sequence of SEQ ID NO:1833, and a VL having an amino acid sequence of SEQ ID NO:1834. In one aspect, provided herein is an antibody that binds CD8, comprising a heavy chain having an amino acid sequence of SEQ ID NO:1835. In one aspect, provided herein is an antibody that binds CD8, comprising a light chain having an amino acid sequence of SEQ ID NO:1836. In one aspect, provided herein is an antibody that binds CD8, comprising a heavy chain having an amino acid sequence of SEQ ID NO:1835, and a light chain having an amino acid sequence of SEQ ID NO:1836. In one aspect, provided herein is an antibody that binds CD8, comprising a VH having an amino acid sequence having at least 95% identity to an amino acid sequence of SEQ ID NO:1833. In one aspect, provided herein is an antibody that binds CD8, comprising a VL having an amino acid sequence having at least 95% identity to an amino acid sequence of SEQ ID NO:1834. In one aspect, provided herein is an antibody that binds CD8, comprising a VH having an amino acid sequence having at least 95% identity to an amino acid sequence of SEQ ID NO:1833, and a VL having an amino acid sequence having at least 95% identity to an amino acid sequence of SEQ ID NO:1834. In one aspect, provided herein is an antibody that binds CD8, comprising a heavy chain having an amino acid sequence having at least 95% identity to an amino acid sequence of SEQ ID NO:1835. In one aspect, provided herein is an antibody that binds CD8, comprising a light chain having an amino acid sequence having at least 95% identity to an amino acid sequence of SEQ ID NO:1836. In one aspect, provided herein is an antibody that binds CD8, comprising a heavy chain having an amino acid sequence having at least 95% identity to an amino acid sequence of SEQ ID NO:1835, and a light chain having an amino acid sequence having at least 95% identity to an amino acid sequence of SEQ ID NO:1836.

In one aspect, provided herein is an antibody that binds CD8, comprising: (i) a VH comprising a VH CDR1, a VH CDR2, and a VH CDR3 having an amino acid sequence of SEQ ID NOs:1837, 1838, and 1839, respectively, and (ii) a VL comprising a VL CDR1, VL CDR2, and VL CDR3 having an amino acid sequence of SEQ ID NOs:1840, 1841, and 1842, respectively. In one aspect, provided herein is an antibody that binds CD8, comprising: (i) a VH comprising a VH CDR1, a VH CDR2, and a VH CDR3 having an amino acid sequence of SEQ ID NOs:1843, 1844, and 1845, respectively, and (ii) a VL comprising a VL CDR1, VL CDR2, and VL CDR3 having an amino acid sequence of SEQ ID NOs:1846, 1847, and 1848, respectively. In one aspect, provided herein is an antibody that binds CD8, comprising: (i) a VH comprising a VH CDR1, a VH CDR2, and a VH CDR3 having an amino acid sequence of SEQ ID NOs:1849, 1850, and 1851, respectively, and (ii) a VL comprising a VL CDR1, VL CDR2, and VL CDR3 having an amino acid sequence of SEQ ID NOs:1852, 1853, and 1854, respectively. In one aspect, provided herein is an antibody that binds CD8, comprising: (i) a VH comprising a VH CDR1, a VH CDR2, and a VH CDR3 having an amino acid sequence of SEQ ID NOs:1855, 1856, and 1857, respectively, and (ii) a VL comprising a VL CDR1, VL CDR2, and VL CDR3 having an amino acid sequence of SEQ ID NOs:1858, 1859, and 1860, respectively. In one aspect, provided herein is an antibody that binds CD8, comprising: (i) a VH comprising a VH CDR1, a VH CDR2, and a VH CDR3 having an amino acid sequence of SEQ ID NOs:1861, 1862, and 1863, respectively, and (ii) a VL comprising a VL CDR1, VL CDR2, and VL CDR3 having an amino acid sequence of SEQ ID NOs:1864, 1865, and 1866, respectively. In one aspect, provided herein is an antibody that binds CD8, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1867; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1868. In one aspect, provided herein is an antibody that binds CD8, comprising a VH having an amino acid sequence of SEQ ID NO:1867. In one aspect, provided herein is an antibody that binds CD8, comprising a VL having an amino acid sequence of SEQ ID NO:1868. In one aspect, provided herein is an antibody that binds CD8, comprising a VH having an amino acid sequence of SEQ ID NO:1867, and a VL having an amino acid sequence of SEQ ID NO:1868. In one aspect, provided herein is an antibody that binds CD8, comprising a heavy chain having an amino acid sequence of SEQ ID NO:1869. In one aspect, provided herein is an antibody that binds CD8, comprising a light chain having an amino acid sequence of SEQ ID NO:1870. In one aspect, provided herein is an antibody that binds CD8, comprising a heavy chain having an amino acid sequence of SEQ ID NO:1869, and a light chain having an amino acid sequence of SEQ ID NO:1870. In one aspect, provided herein is an antibody that binds CD8, comprising a VH having an amino acid sequence having at least 95% identity to an amino acid sequence of SEQ ID NO:1867. In one aspect, provided herein is an antibody that binds CD8, comprising a VL having an amino acid sequence having at least 95% identity to an amino acid sequence of SEQ ID NO:1868. In one aspect, provided herein is an antibody that binds CD8, comprising a VH having an amino acid sequence having at least 95% identity to an amino acid sequence of SEQ ID NO:1867, and a VL having an amino acid sequence having at least 95% identity to an amino acid sequence of SEQ ID NO:1868. In one aspect, provided herein is an antibody that binds CD8, comprising a heavy chain having an amino acid sequence having at least 95% identity to an amino acid sequence of SEQ ID NO:1869. In one aspect, provided herein is an antibody that binds CD8, comprising a light chain having an amino acid sequence having at least 95% identity to an amino acid sequence of SEQ ID NO:1870. In one aspect, provided herein is an antibody that binds CD8, comprising a heavy chain having an amino acid sequence having at least 95% identity to an amino acid sequence of SEQ ID NO:1869, and a light chain having an amino acid sequence having at least 95% identity to an amino acid sequence of SEQ ID NO:1870.

In one aspect, provided herein is an antibody that binds CD8, comprising: (i) a VH comprising a VH CDR1, a VH CDR2, and a VH CDR3 having an amino acid sequence of SEQ ID NOs:1871, 1872, and 1873, respectively, and (ii) a VL comprising a VL CDR1, VL CDR2, and VL CDR3 having an amino acid sequence of SEQ ID NOs:1874, 1875, and 1876, respectively. In one aspect, provided herein is an antibody that binds CD8, comprising: (i) a VH comprising a VH CDR1, a VH CDR2, and a VH CDR3 having an amino acid sequence of SEQ ID NOs:1877, 1878, and 1879, respectively, and (ii) a VL comprising a VL CDR1, VL CDR2, and VL CDR3 having an amino acid sequence of SEQ ID NOs:1880, 1881, and 1882, respectively. In one aspect, provided herein is an antibody that binds CD8, comprising: (i) a VH comprising a VH CDR1, a VH CDR2, and a VH CDR3 having an amino acid sequence of SEQ ID NOs:1883, 1884, and 1885, respectively, and (ii) a VL comprising a VL CDR1, VL CDR2, and VL CDR3 having an amino acid sequence of SEQ ID NOs:1886, 1887, and 1888, respectively. In one aspect, provided herein is an antibody that binds CD8, comprising: (i) a VH comprising a VH CDR1, a VH CDR2, and a VH CDR3 having an amino acid sequence of SEQ ID NOs:1889, 1890, and 1891, respectively, and (ii) a VL comprising a VL CDR1, VL CDR2, and VL CDR3 having an amino acid sequence of SEQ ID NOs:1892, 1893, and 1894, respectively. In one aspect, provided herein is an antibody that binds CD8, comprising: (i) a VH comprising a VH CDR1, a VH CDR2, and a VH CDR3 having an amino acid sequence of SEQ ID NOs:1895, 1896, and 1897, respectively, and (ii) a VL comprising a VL CDR1, VL CDR2, and VL CDR3 having an amino acid sequence of SEQ ID NOs:1898, 1899, and 1900, respectively. In one aspect, provided herein is an antibody that binds CD8, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1901; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1902. In one aspect, provided herein is an antibody that binds CD8, comprising a VH having an amino acid sequence of SEQ ID NO:1901. In one aspect, provided herein is an antibody that binds CD8, comprising a VL having an amino acid sequence of SEQ ID NO:1902. In one aspect, provided herein is an antibody that binds CD8, comprising a VH having an amino acid sequence of SEQ ID NO:1901, and a VL having an amino acid sequence of SEQ ID NO:1902. In one aspect, provided herein is an antibody that binds CD8, comprising a heavy chain having an amino acid sequence of SEQ ID NO:1903. In one aspect, provided herein is an antibody that binds CD8, comprising a light chain having an amino acid sequence of SEQ ID NO:1904. In one aspect, provided herein is an antibody that binds CD8, comprising a heavy chain having an amino acid sequence of SEQ ID NO:1903, and a light chain having an amino acid sequence of SEQ ID NO:1904. In one aspect, provided herein is an antibody that binds CD8, comprising a VH having an amino acid sequence having at least 95% identity to an amino acid sequence of SEQ ID NO:1901. In one aspect, provided herein is an antibody that binds CD8, comprising a VL having an amino acid sequence having at least 95% identity to an amino acid sequence of SEQ ID NO:1902. In one aspect, provided herein is an antibody that binds CD8, comprising a VH having an amino acid sequence having at least 95% identity to an amino acid sequence of SEQ ID NO:1901, and a VL having an amino acid sequence having at least 95% identity to an amino acid sequence of SEQ ID NO:1902. In one aspect, provided herein is an antibody that binds CD8, comprising a heavy chain having an amino acid sequence having at least 95% identity to an amino acid sequence of SEQ ID NO:1903. In one aspect, provided herein is an antibody that binds CD8, comprising a light chain having an amino acid sequence having at least 95% identity to an amino acid sequence of SEQ ID NO:1904. In one aspect, provided herein is an antibody that binds CD8, comprising a heavy chain having an amino acid sequence having at least 95% identity to an amino acid sequence of SEQ ID NO:1903, and a light chain having an amino acid sequence having at least 95% identity to an amino acid sequence of SEQ ID NO:1904.

In one aspect, provided herein is an antibody that binds CD8, comprising: (i) a VH comprising a VH CDR1, a VH CDR2, and a VH CDR3 having an amino acid sequence of SEQ ID NOs:1905, 1906, and 1907, respectively, and (ii) a VL comprising a VL CDR1, VL CDR2, and VL CDR3 having an amino acid sequence of SEQ ID NOs:1908, 1909, and 1910, respectively. In one aspect, provided herein is an antibody that binds CD8, comprising: (i) a VH comprising a VH CDR1, a VH CDR2, and a VH CDR3 having an amino acid sequence of SEQ ID NOs:1911, 1912, and 1913, respectively, and (ii) a VL comprising a VL CDR1, VL CDR2, and VL CDR3 having an amino acid sequence of SEQ ID NOs:1914, 1915, and 1916, respectively. In one aspect, provided herein is an antibody that binds CD8, comprising: (i) a VH comprising a VH CDR1, a VH CDR2, and a VH CDR3 having an amino acid sequence of SEQ ID NOs:1917, 1918, and 1919, respectively, and (ii) a VL comprising a VL CDR1, VL CDR2, and VL CDR3 having an amino acid sequence of SEQ ID NOs:1920, 1921, and 1922, respectively. In one aspect, provided herein is an antibody that binds CD8, comprising: (i) a VH comprising a VH CDR1, a VH CDR2, and a VH CDR3 having an amino acid sequence of SEQ ID NOs:1923, 1924, and 1925, respectively, and (ii) a VL comprising a VL CDR1, VL CDR2, and VL CDR3 having an amino acid sequence of SEQ ID NOs:1926, 1927, and 1928, respectively. In one aspect, provided herein is an antibody that binds CD8, comprising: (i) a VH comprising a VH CDR1, a VH CDR2, and a VH CDR3 having an amino acid sequence of SEQ ID NOs:1929, 1930, and 1931, respectively, and (ii) a VL comprising a VL CDR1, VL CDR2, and VL CDR3 having an amino acid sequence of SEQ ID NOs:1932, 1933, and 1934, respectively. In one aspect, provided herein is an antibody that binds CD8, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1935; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1936. In one aspect, provided herein is an antibody that binds CD8, comprising a VH having an amino acid sequence of SEQ ID NO:1935. In one aspect, provided herein is an antibody that binds CD8, comprising a VL having an amino acid sequence of SEQ ID NO:1936. In one aspect, provided herein is an antibody that binds CD8, comprising a VH having an amino acid sequence of SEQ ID NO:1935, and a VL having an amino acid sequence of SEQ ID NO:1936. In one aspect, provided herein is an antibody that binds CD8, comprising a heavy chain having an amino acid sequence of SEQ ID NO:1937. In one aspect, provided herein is an antibody that binds CD8, comprising a light chain having an amino acid sequence of SEQ ID NO:1938. In one aspect, provided herein is an antibody that binds CD8, comprising a heavy chain having an amino acid sequence of SEQ ID NO:1937, and a light chain having an amino acid sequence of SEQ ID NO:1938. In one aspect, provided herein is an antibody that binds CD8, comprising a VH having an amino acid sequence having at least 95% identity to an amino acid sequence of SEQ ID NO:1935. In one aspect, provided herein is an antibody that binds CD8, comprising a VL having an amino acid sequence having at least 95% identity to an amino acid sequence of SEQ ID NO:1936. In one aspect, provided herein is an antibody that binds CD8, comprising a VH having an amino acid sequence having at least 95% identity to an amino acid sequence of SEQ ID NO:1935, and a VL having an amino acid sequence having at least 95% identity to an amino acid sequence of SEQ ID NO:1936. In one aspect, provided herein is an antibody that binds CD8, comprising a heavy chain having an amino acid sequence having at least 95% identity to an amino acid sequence of SEQ ID NO:1937. In one aspect, provided herein is an antibody that binds CD8, comprising a light chain having an amino acid sequence having at least 95% identity to an amino acid sequence of SEQ ID NO:1938. In one aspect, provided herein is an antibody that binds CD8, comprising a heavy chain having an amino acid sequence having at least 95% identity to an amino acid sequence of SEQ ID NO:1937, and a light chain having an amino acid sequence having at least 95% identity to an amino acid sequence of SEQ ID NO:1938.

In one aspect, provided herein is an antibody that binds CD8, comprising: (i) a VH comprising a VH CDR1, a VH CDR2, and a VH CDR3 having an amino acid sequence of SEQ ID NOs:1939, 1940, and 1941, respectively, and (ii) a VL comprising a VL CDR1, VL CDR2, and VL CDR3 having an amino acid sequence of SEQ ID NOs:1942, 1943, and 1944, respectively. In one aspect, provided herein is an antibody that binds CD8, comprising: (i) a VH comprising a VH CDR1, a VH CDR2, and a VH CDR3 having an amino acid sequence of SEQ ID NOs:1945, 1946, and 1947, respectively, and (ii) a VL comprising a VL CDR1, VL CDR2, and VL CDR3 having an amino acid sequence of SEQ ID NOs:1948, 1949, and 1950, respectively. In one aspect, provided herein is an antibody that binds CD8, comprising: (i) a VH comprising a VH CDR1, a VH CDR2, and a VH CDR3 having an amino acid sequence of SEQ ID NOs:1951, 1952, and 1953, respectively, and (ii) a VL comprising a VL CDR1, VL CDR2, and VL CDR3 having an amino acid sequence of SEQ ID NOs:1954, 1955, and 1956, respectively. In one aspect, provided herein is an antibody that binds CD8, comprising: (i) a VH comprising a VH CDR1, a VH CDR2, and a VH CDR3 having an amino acid sequence of SEQ ID NOs:1957, 1958, and 1959, respectively, and (ii) a VL comprising a VL CDR1, VL CDR2, and VL CDR3 having an amino acid sequence of SEQ ID NOs:1960, 1961, and 1962, respectively. In one aspect, provided herein is an antibody that binds CD8, comprising: (i) a VH comprising a VH CDR1, a VH CDR2, and a VH CDR3 having an amino acid sequence of SEQ ID NOs:1963, 1964, and 1965, respectively, and (ii) a VL comprising a VL CDR1, VL CDR2, and VL CDR3 having an amino acid sequence of SEQ ID NOs:1966, 1967, and 1968, respectively. In one aspect, provided herein is an antibody that binds CD8, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1969; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1970. In one aspect, provided herein is an antibody that binds CD8, comprising a VH having an amino acid sequence of SEQ ID NO:1969. In one aspect, provided herein is an antibody that binds CD8, comprising a VL having an amino acid sequence of SEQ ID NO:1970. In one aspect, provided herein is an antibody that binds CD8, comprising a VH having an amino acid sequence of SEQ ID NO:1969, and a VL having an amino acid sequence of SEQ ID NO:1970. In one aspect, provided herein is an antibody that binds CD8, comprising a heavy chain having an amino acid sequence of SEQ ID NO:1971. In one aspect, provided herein is an antibody that binds CD8, comprising a light chain having an amino acid sequence of SEQ ID NO:1972. In one aspect, provided herein is an antibody that binds CD8, comprising a heavy chain having an amino acid sequence of SEQ ID NO:1971, and a light chain having an amino acid sequence of SEQ ID NO:1972. In one aspect, provided herein is an antibody that binds CD8, comprising a VH having an amino acid sequence having at least 95% identity to an amino acid sequence of SEQ ID NO:1969. In one aspect, provided herein is an antibody that binds CD8, comprising a VL having an amino acid sequence having at least 95% identity to an amino acid sequence of SEQ ID NO:1970. In one aspect, provided herein is an antibody that binds CD8, comprising a VH having an amino acid sequence having at least 95% identity to an amino acid sequence of SEQ ID NO:1969, and a VL having an amino acid sequence having at least 95% identity to an amino acid sequence of SEQ ID NO:1970. In one aspect, provided herein is an antibody that binds CD8, comprising a heavy chain having an amino acid sequence having at least 95% identity to an amino acid sequence of SEQ ID NO:1971. In one aspect, provided herein is an antibody that binds CD8, comprising a light chain having an amino acid sequence having at least 95% identity to an amino acid sequence of SEQ ID NO:1972. In one aspect, provided herein is an antibody that binds CD8, comprising a heavy chain having an amino acid sequence having at least 95% identity to an amino acid sequence of SEQ ID NO:1971, and a light chain having an amino acid sequence having at least 95% identity to an amino acid sequence of SEQ ID NO:1972.

In one aspect, provided herein is an antibody that binds CD8, comprising: (i) a VH comprising a VH CDR1, a VH CDR2, and a VH CDR3 having an amino acid sequence of SEQ ID NOs:1973, 1974, and 1975, respectively, and (ii) a VL comprising a VL CDR1, VL CDR2, and VL CDR3 having an amino acid sequence of SEQ ID NOs:1976, 1977, and 1978, respectively. In one aspect, provided herein is an antibody that binds CD8, comprising: (i) a VH comprising a VH CDR1, a VH CDR2, and a VH CDR3 having an amino acid sequence of SEQ ID NOs:1979, 1980, and 1981, respectively, and (ii) a VL comprising a VL CDR1, VL CDR2, and VL CDR3 having an amino acid sequence of SEQ ID NOs:1982, 1983, and 1984, respectively. In one aspect, provided herein is an antibody that binds CD8, comprising: (i) a VH comprising a VH CDR1, a VH CDR2, and a VH CDR3 having an amino acid sequence of SEQ ID NOs:1985, 1986, and 1987, respectively, and (ii) a VL comprising a VL CDR1, VL CDR2, and VL CDR3 having an amino acid sequence of SEQ ID NOs:1988, 1989, and 1990, respectively. In one aspect, provided herein is an antibody that binds CD8, comprising: (i) a VH comprising a VH CDR1, a VH CDR2, and a VH CDR3 having an amino acid sequence of SEQ ID NOs:1991, 1992, and 1993, respectively, and (ii) a VL comprising a VL CDR1, VL CDR2, and VL CDR3 having an amino acid sequence of SEQ ID NOs:1994, 1995, and 1996, respectively. In one aspect, provided herein is an antibody that binds CD8, comprising: (i) a VH comprising a VH CDR1, a VH CDR2, and a VH CDR3 having an amino acid sequence of SEQ ID NOs:1997, 1998, and 1999, respectively, and (ii) a VL comprising a VL CDR1, VL CDR2, and VL CDR3 having an amino acid sequence of SEQ ID NOs:2000, 2001, and 2002, respectively. In one aspect, provided herein is an antibody that binds CD8, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2003; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2004. In one aspect, provided herein is an antibody that binds CD8, comprising a VH having an amino acid sequence of SEQ ID NO:2003. In one aspect, provided herein is an antibody that binds CD8, comprising a VL having an amino acid sequence of SEQ ID NO:2004. In one aspect, provided herein is an antibody that binds CD8, comprising a VH having an amino acid sequence of SEQ ID NO:2003, and a VL having an amino acid sequence of SEQ ID NO:2004. In one aspect, provided herein is an antibody that binds CD8, comprising a heavy chain having an amino acid sequence of SEQ ID NO:2005. In one aspect, provided herein is an antibody that binds CD8, comprising a light chain having an amino acid sequence of SEQ ID NO:2006. In one aspect, provided herein is an antibody that binds CD8, comprising a heavy chain having an amino acid sequence of SEQ ID NO:2005, and a light chain having an amino acid sequence of SEQ ID NO:2006. In one aspect, provided herein is an antibody that binds CD8, comprising a VH having an amino acid sequence having at least 95% identity to an amino acid sequence of SEQ ID NO:2003. In one aspect, provided herein is an antibody that binds CD8, comprising a VL having an amino acid sequence having at least 95% identity to an amino acid sequence of SEQ ID NO:2004. In one aspect, provided herein is an antibody that binds CD8, comprising a VH having an amino acid sequence having at least 95% identity to an amino acid sequence of SEQ ID NO:2003, and a VL having an amino acid sequence having at least 95% identity to an amino acid sequence of SEQ ID NO:2004. In one aspect, provided herein is an antibody that binds CD8, comprising a heavy chain having an amino acid sequence having at least 95% identity to an amino acid sequence of SEQ ID NO:2005. In one aspect, provided herein is an antibody that binds CD8, comprising a light chain having an amino acid sequence having at least 95% identity to an amino acid sequence of SEQ ID NO:2006. In one aspect, provided herein is an antibody that binds CD8, comprising a heavy chain having an amino acid sequence having at least 95% identity to an amino acid sequence of SEQ ID NO:2005, and a light chain having an amino acid sequence having at least 95% identity to an amino acid sequence of SEQ ID NO:2006.

In one aspect, provided herein is an antibody that binds CD8, comprising: (i) a VH comprising a VH CDR1, a VH CDR2, and a VH CDR3 having an amino acid sequence of SEQ ID NOs:2007, 2008, and 2009, respectively, and (ii) a VL comprising a VL CDR1, VL CDR2, and VL CDR3 having an amino acid sequence of SEQ ID NOs:2010, 2011, and 2012, respectively. In one aspect, provided herein is an antibody that binds CD8, comprising: (i) a VH comprising a VH CDR1, a VH CDR2, and a VH CDR3 having an amino acid sequence of SEQ ID NOs:2013, 2014, and 2015, respectively, and (ii) a VL comprising a VL CDR1, VL CDR2, and VL CDR3 having an amino acid sequence of SEQ ID NOs:2016, 2017, and 2018, respectively. In one aspect, provided herein is an antibody that binds CD8, comprising: (i) a VH comprising a VH CDR1, a VH CDR2, and a VH CDR3 having an amino acid sequence of SEQ ID NOs:2019, 2020, and 2021, respectively, and (ii) a VL comprising a VL CDR1, VL CDR2, and VL CDR3 having an amino acid sequence of SEQ ID NOs:2022, 2023, and 2024, respectively. In one aspect, provided herein is an antibody that binds CD8, comprising: (i) a VH comprising a VH CDR1, a VH CDR2, and a VH CDR3 having an amino acid sequence of SEQ ID NOs:2025, 2026, and 2027, respectively, and (ii) a VL comprising a VL CDR1, VL CDR2, and VL CDR3 having an amino acid sequence of SEQ ID NOs:2028, 2029, and 2030, respectively. In one aspect, provided herein is an antibody that binds CD8, comprising: (i) a VH comprising a VH CDR1, a VH CDR2, and a VH CDR3 having an amino acid sequence of SEQ ID NOs:2031, 2032, and 2033, respectively, and (ii) a VL comprising a VL CDR1, VL CDR2, and VL CDR3 having an amino acid sequence of SEQ ID NOs:2034, 2035, and 2036, respectively. In one aspect, provided herein is an antibody that binds CD8, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2037; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2038. In one aspect, provided herein is an antibody that binds CD8, comprising a VH having an amino acid sequence of SEQ ID NO:2037. In one aspect, provided herein is an antibody that binds CD8, comprising a VL having an amino acid sequence of SEQ ID NO:2038. In one aspect, provided herein is an antibody that binds CD8, comprising a VH having an amino acid sequence of SEQ ID NO:2037, and a VL having an amino acid sequence of SEQ ID NO:2038. In one aspect, provided herein is an antibody that binds CD8, comprising a heavy chain having an amino acid sequence of SEQ ID NO:2039. In one aspect, provided herein is an antibody that binds CD8, comprising a light chain having an amino acid sequence of SEQ ID NO:2040. In one aspect, provided herein is an antibody that binds CD8, comprising a heavy chain having an amino acid sequence of SEQ ID NO:2039, and a light chain having an amino acid sequence of SEQ ID NO:2040. In one aspect, provided herein is an antibody that binds CD8, comprising a VH having an amino acid sequence having at least 95% identity to an amino acid sequence of SEQ ID NO:2037. In one aspect, provided herein is an antibody that binds CD8, comprising a VL having an amino acid sequence having at least 95% identity to an amino acid sequence of SEQ ID NO:2038. In one aspect, provided herein is an antibody that binds CD8, comprising a VH having an amino acid sequence having at least 95% identity to an amino acid sequence of SEQ ID NO:2037, and a VL having an amino acid sequence having at least 95% identity to an amino acid sequence of SEQ ID NO:2038. In one aspect, provided herein is an antibody that binds CD8, comprising a heavy chain having an amino acid sequence having at least 95% identity to an amino acid sequence of SEQ ID NO:2039. In one aspect, provided herein is an antibody that binds CD8, comprising a light chain having an amino acid sequence having at least 95% identity to an amino acid sequence of SEQ ID NO:2040. In one aspect, provided herein is an antibody that binds CD8, comprising a heavy chain having an amino acid sequence having at least 95% identity to an amino acid sequence of SEQ ID NO:2039, and a light chain having an amino acid sequence having at least 95% identity to an amino acid sequence of SEQ ID NO:2040.

In one aspect, provided herein is an antibody that binds CD8, comprising: (i) a VH comprising a VH CDR1, a VH CDR2, and a VH CDR3 having an amino acid sequence of SEQ ID NOs:2041, 2042, and 2043, respectively, and (ii) a VL comprising a VL CDR1, VL CDR2, and VL CDR3 having an amino acid sequence of SEQ ID NOs:2044, 2045, and 2046, respectively. In one aspect, provided herein is an antibody that binds CD8, comprising: (i) a VH comprising a VH CDR1, a VH CDR2, and a VH CDR3 having an amino acid sequence of SEQ ID NOs:2047, 2048, and 2049, respectively, and (ii) a VL comprising a VL CDR1, VL CDR2, and VL CDR3 having an amino acid sequence of SEQ ID NOs:2050, 2051, and 2052, respectively. In one aspect, provided herein is an antibody that binds CD8, comprising: (i) a VH comprising a VH CDR1, a VH CDR2, and a VH CDR3 having an amino acid sequence of SEQ ID NOs:2053, 2054, and 2055, respectively, and (ii) a VL comprising a VL CDR1, VL CDR2, and VL CDR3 having an amino acid sequence of SEQ ID NOs:2056, 2057, and 2058, respectively. In one aspect, provided herein is an antibody that binds CD8, comprising: (i) a VH comprising a VH CDR1, a VH CDR2, and a VH CDR3 having an amino acid sequence of SEQ ID NOs:2059, 2060, and 2061, respectively, and (ii) a VL comprising a VL CDR1, VL CDR2, and VL CDR3 having an amino acid sequence of SEQ ID NOs:2062, 2063, and 2064, respectively. In one aspect, provided herein is an antibody that binds CD8, comprising: (i) a VH comprising a VH CDR1, a VH CDR2, and a VH CDR3 having an amino acid sequence of SEQ ID NOs:2065, 2066, and 2067, respectively, and (ii) a VL comprising a VL CDR1, VL CDR2, and VL CDR3 having an amino acid sequence of SEQ ID NOs:2068, 2069, and 2070, respectively. In one aspect, provided herein is an antibody that binds CD8, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2071; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2072. In one aspect, provided herein is an antibody that binds CD8, comprising a VH having an amino acid sequence of SEQ ID NO:2071. In one aspect, provided herein is an antibody that binds CD8, comprising a VL having an amino acid sequence of SEQ ID NO:2072. In one aspect, provided herein is an antibody that binds CD8, comprising a VH having an amino acid sequence of SEQ ID NO:2071, and a VL having an amino acid sequence of SEQ ID NO:2072. In one aspect, provided herein is an antibody that binds CD8, comprising a heavy chain having an amino acid sequence of SEQ ID NO:2073. In one aspect, provided herein is an antibody that binds CD8, comprising a light chain having an amino acid sequence of SEQ ID NO:2074. In one aspect, provided herein is an antibody that binds CD8, comprising a heavy chain having an amino acid sequence of SEQ ID NO:2073, and a light chain having an amino acid sequence of SEQ ID NO:2074. In one aspect, provided herein is an antibody that binds CD8, comprising a VH having an amino acid sequence having at least 95% identity to an amino acid sequence of SEQ ID NO:2071. In one aspect, provided herein is an antibody that binds CD8, comprising a VL having an amino acid sequence having at least 95% identity to an amino acid sequence of SEQ ID NO:2072. In one aspect, provided herein is an antibody that binds CD8, comprising a VH having an amino acid sequence having at least 95% identity to an amino acid sequence of SEQ ID NO:2071, and a VL having an amino acid sequence having at least 95% identity to an amino acid sequence of SEQ ID NO:2072. In one aspect, provided herein is an antibody that binds CD8, comprising a heavy chain having an amino acid sequence having at least 95% identity to an amino acid sequence of SEQ ID NO:2073. In one aspect, provided herein is an antibody that binds CD8, comprising a light chain having an amino acid sequence having at least 95% identity to an amino acid sequence of SEQ ID NO:2074. In one aspect, provided herein is an antibody that binds CD8, comprising a heavy chain having an amino acid sequence having at least 95% identity to an amino acid sequence of SEQ ID NO:2073, and a light chain having an amino acid sequence having at least 95% identity to an amino acid sequence of SEQ ID NO:2074.

In one aspect, provided herein is an antibody that binds CD8, comprising: (i) a VH comprising a VH CDR1, a VH CDR2, and a VH CDR3 having an amino acid sequence of SEQ ID NOs:2075, 2076, and 2077, respectively, and (ii) a VL comprising a VL CDR1, VL CDR2, and VL CDR3 having an amino acid sequence of SEQ ID NOs:2078, 2079, and 2080, respectively. In one aspect, provided herein is an antibody that binds CD8, comprising: (i) a VH comprising a VH CDR1, a VH CDR2, and a VH CDR3 having an amino acid sequence of SEQ ID NOs:2081, 2082, and 2083, respectively, and (ii) a VL comprising a VL CDR1, VL CDR2, and VL CDR3 having an amino acid sequence of SEQ ID NOs:2084, 2085, and 2086, respectively. In one aspect, provided herein is an antibody that binds CD8, comprising: (i) a VH comprising a VH CDR1, a VH CDR2, and a VH CDR3 having an amino acid sequence of SEQ ID NOs:2087, 2088, and 2089, respectively, and (ii) a VL comprising a VL CDR1, VL CDR2, and VL CDR3 having an amino acid sequence of SEQ ID NOs:2090, 2091, and 2092, respectively. In one aspect, provided herein is an antibody that binds CD8, comprising: (i) a VH comprising a VH CDR1, a VH CDR2, and a VH CDR3 having an amino acid sequence of SEQ ID NOs:2093, 2094, and 2095, respectively, and (ii) a VL comprising a VL CDR1, VL CDR2, and VL CDR3 having an amino acid sequence of SEQ ID NOs:2096, 2097, and 2098, respectively. In one aspect, provided herein is an antibody that binds CD8, comprising: (i) a VH comprising a VH CDR1, a VH CDR2, and a VH CDR3 having an amino acid sequence of SEQ ID NOs:2099, 2100, and 2101, respectively, and (ii) a VL comprising a VL CDR1, VL CDR2, and VL CDR3 having an amino acid sequence of SEQ ID NOs:2102, 2103, and 2104, respectively. In one aspect, provided herein is an antibody that binds CD8, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2105; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2106. In one aspect, provided herein is an antibody that binds CD8, comprising a VH having an amino acid sequence of SEQ ID NO:2105. In one aspect, provided herein is an antibody that binds CD8, comprising a VL having an amino acid sequence of SEQ ID NO:2106. In one aspect, provided herein is an antibody that binds CD8, comprising a VH having an amino acid sequence of SEQ ID NO:2105, and a VL having an amino acid sequence of SEQ ID NO:2106. In one aspect, provided herein is an antibody that binds CD8, comprising a heavy chain having an amino acid sequence of SEQ ID NO:2107. In one aspect, provided herein is an antibody that binds CD8, comprising a light chain having an amino acid sequence of SEQ ID NO:2108. In one aspect, provided herein is an antibody that binds CD8, comprising a heavy chain having an amino acid sequence of SEQ ID NO:2107, and a light chain having an amino acid sequence of SEQ ID NO:2108. In one aspect, provided herein is an antibody that binds CD8, comprising a VH having an amino acid sequence having at least 95% identity to an amino acid sequence of SEQ ID NO:2105. In one aspect, provided herein is an antibody that binds CD8, comprising a VL having an amino acid sequence having at least 95% identity to an amino acid sequence of SEQ ID NO:2106. In one aspect, provided herein is an antibody that binds CD8, comprising a VH having an amino acid sequence having at least 95% identity to an amino acid sequence of SEQ ID NO:2105, and a VL having an amino acid sequence having at least 95% identity to an amino acid sequence of SEQ ID NO:2106. In one aspect, provided herein is an antibody that binds CD8, comprising a heavy chain having an amino acid sequence having at least 95% identity to an amino acid sequence of SEQ ID NO:2107. In one aspect, provided herein is an antibody that binds CD8, comprising a light chain having an amino acid sequence having at least 95% identity to an amino acid sequence of SEQ ID NO:2108. In one aspect, provided herein is an antibody that binds CD8, comprising a heavy chain having an amino acid sequence having at least 95% identity to an amino acid sequence of SEQ ID NO:2107, and a light chain having an amino acid sequence having at least 95% identity to an amino acid sequence of SEQ ID NO:2108.

In one aspect, provided herein is an antibody that binds CD8, comprising: (i) a VH comprising a VH CDR1, a VH CDR2, and a VH CDR3 having an amino acid sequence of SEQ ID NOs:2109, 2110, and 2111, respectively, and (ii) a VL comprising a VL CDR1, VL CDR2, and VL CDR3 having an amino acid sequence of SEQ ID NOs:2112, 2113, and 2114, respectively. In one aspect, provided herein is an antibody that binds CD8, comprising: (i) a VH comprising a VH CDR1, a VH CDR2, and a VH CDR3 having an amino acid sequence of SEQ ID NOs:2115, 2116, and 2117, respectively, and (ii) a VL comprising a VL CDR1, VL CDR2, and VL CDR3 having an amino acid sequence of SEQ ID NOs:2118, 2119, and 2120, respectively. In one aspect, provided herein is an antibody that binds CD8, comprising: (i) a VH comprising a VH CDR1, a VH CDR2, and a VH CDR3 having an amino acid sequence of SEQ ID NOs:2121, 2122, and 2123, respectively, and (ii) a VL comprising a VL CDR1, VL CDR2, and VL CDR3 having an amino acid sequence of SEQ ID NOs:2124, 2125, and 2126, respectively. In one aspect, provided herein is an antibody that binds CD8, comprising: (i) a VH comprising a VH CDR1, a VH CDR2, and a VH CDR3 having an amino acid sequence of SEQ ID NOs:2127, 2128, and 2129, respectively, and (ii) a VL comprising a VL CDR1, VL CDR2, and VL CDR3 having an amino acid sequence of SEQ ID NOs:2130, 2131, and 2132, respectively. In one aspect, provided herein is an antibody that binds CD8, comprising: (i) a VH comprising a VH CDR1, a VH CDR2, and a VH CDR3 having an amino acid sequence of SEQ ID NOs:2133, 2134, and 2135, respectively, and (ii) a VL comprising a VL CDR1, VL CDR2, and VL CDR3 having an amino acid sequence of SEQ ID NOs:2136, 2137, and 2138, respectively. In one aspect, provided herein is an antibody that binds CD8, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2139; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2140. In one aspect, provided herein is an antibody that binds CD8, comprising a VH having an amino acid sequence of SEQ ID NO:2139. In one aspect, provided herein is an antibody that binds CD8, comprising a VL having an amino acid sequence of SEQ ID NO:2140. In one aspect, provided herein is an antibody that binds CD8, comprising a VH having an amino acid sequence of SEQ ID NO:2139, and a VL having an amino acid sequence of SEQ ID NO:2140. In one aspect, provided herein is an antibody that binds CD8, comprising a heavy chain having an amino acid sequence of SEQ ID NO:2141. In one aspect, provided herein is an antibody that binds CD8, comprising a light chain having an amino acid sequence of SEQ ID NO:2142. In one aspect, provided herein is an antibody that binds CD8, comprising a heavy chain having an amino acid sequence of SEQ ID NO:2141, and a light chain having an amino acid sequence of SEQ ID NO:2142. In one aspect, provided herein is an antibody that binds CD8, comprising a VH having an amino acid sequence having at least 95% identity to an amino acid sequence of SEQ ID NO:2139. In one aspect, provided herein is an antibody that binds CD8, comprising a VL having an amino acid sequence having at least 95% identity to an amino acid sequence of SEQ ID NO:2140. In one aspect, provided herein is an antibody that binds CD8, comprising a VH having an amino acid sequence having at least 95% identity to an amino acid sequence of SEQ ID NO:2139, and a VL having an amino acid sequence having at least 95% identity to an amino acid sequence of SEQ ID NO:2140. In one aspect, provided herein is an antibody that binds CD8, comprising a heavy chain having an amino acid sequence having at least 95% identity to an amino acid sequence of SEQ ID NO:2141. In one aspect, provided herein is an antibody that binds CD8, comprising a light chain having an amino acid sequence having at least 95% identity to an amino acid sequence of SEQ ID NO:2142. In one aspect, provided herein is an antibody that binds CD8, comprising a heavy chain having an amino acid sequence having at least 95% identity to an amino acid sequence of SEQ ID NO:2141, and a light chain having an amino acid sequence having at least 95% identity to an amino acid sequence of SEQ ID NO:2142.

In one aspect, provided herein is an antibody that binds CD8, comprising: (i) a VH comprising a VH CDR1, a VH CDR2, and a VH CDR3 having an amino acid sequence of SEQ ID NOs:2143, 2144, and 2145, respectively, and (ii) a VL comprising a VL CDR1, VL CDR2, and VL CDR3 having an amino acid sequence of SEQ ID NOs:2146, 2147, and 2148, respectively. In one aspect, provided herein is an antibody that binds CD8, comprising: (i) a VH comprising a VH CDR1, a VH CDR2, and a VH CDR3 having an amino acid sequence of SEQ ID NOs:2149, 2150, and 2151, respectively, and (ii) a VL comprising a VL CDR1, VL CDR2, and VL CDR3 having an amino acid sequence of SEQ ID NOs:2152, 2153, and 2154, respectively. In one aspect, provided herein is an antibody that binds CD8, comprising: (i) a VH comprising a VH CDR1, a VH CDR2, and a VH CDR3 having an amino acid sequence of SEQ ID NOs:2155, 2156, and 2157, respectively, and (ii) a VL comprising a VL CDR1, VL CDR2, and VL CDR3 having an amino acid sequence of SEQ ID NOs:2158, 2159, and 2160, respectively. In one aspect, provided herein is an antibody that binds CD8, comprising: (i) a VH comprising a VH CDR1, a VH CDR2, and a VH CDR3 having an amino acid sequence of SEQ ID NOs:2161, 2162, and 2163, respectively, and (ii) a VL comprising a VL CDR1, VL CDR2, and VL CDR3 having an amino acid sequence of SEQ ID NOs:2164, 2165, and 2166, respectively. In one aspect, provided herein is an antibody that binds CD8, comprising: (i) a VH comprising a VH CDR1, a VH CDR2, and a VH CDR3 having an amino acid sequence of SEQ ID NOs:2167, 2168, and 2169, respectively, and (ii) a VL comprising a VL CDR1, VL CDR2, and VL CDR3 having an amino acid sequence of SEQ ID NOs:2170, 2171, and 2172, respectively. In one aspect, provided herein is an antibody that binds CD8, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2173; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2174.

In one aspect, provided herein is an antibody that binds CD8, comprising a VH having an amino acid sequence of SEQ ID NO:2173. In one aspect, provided herein is an antibody that binds CD8, comprising a VL having an amino acid sequence of SEQ ID NO:2174. In one aspect, provided herein is an antibody that binds CD8, comprising a VH having an amino acid sequence of SEQ ID NO:2173, and a VL having an amino acid sequence of SEQ ID NO:2174. In one aspect, provided herein is an antibody that binds CD8, comprising a heavy chain having an amino acid sequence of SEQ ID NO:2175. In one aspect, provided herein is an antibody that binds CD8, comprising a light chain having an amino acid sequence of SEQ ID NO:2176. In one aspect, provided herein is an antibody that binds CD8, comprising a heavy chain having an amino acid sequence of SEQ ID NO:2175, and a light chain having an amino acid sequence of SEQ ID NO:2176. In one aspect, provided herein is an antibody that binds CD8, comprising a VH having an amino acid sequence having at least 95% identity to an amino acid sequence of SEQ ID NO:2173. In one aspect, provided herein is an antibody that binds CD8, comprising a VL having an amino acid sequence having at least 95% identity to an amino acid sequence of SEQ ID NO:2174. In one aspect, provided herein is an antibody that binds CD8, comprising a VH having an amino acid sequence having at least 95% identity to an amino acid sequence of SEQ ID NO:2173, and a VL having an amino acid sequence having at least 95% identity to an amino acid sequence of SEQ ID NO:2174. In one aspect, provided herein is an antibody that binds CD8, comprising a heavy chain having an amino acid sequence having at least 95% identity to an amino acid sequence of SEQ ID NO:2175. In one aspect, provided herein is an antibody that binds CD8, comprising a light chain having an amino acid sequence having at least 95% identity to an amino acid sequence of SEQ ID NO:2176. In one aspect, provided herein is an antibody that binds CD8, comprising a heavy chain having an amino acid sequence having at least 95% identity to an amino acid sequence of SEQ ID NO:2175, and a light chain having an amino acid sequence having at least 95% identity to an amino acid sequence of SEQ ID NO:2176.

In one aspect, provided herein is an antibody that binds CD8, comprising a VH CDR1 having an amino acid sequence of SEQ ID NO:25, wherein the third amino acid is S or T; a VH CDR2 having an amino acid sequence of SEQ ID NO:26, wherein the first amino acid is I or V, the fourth amino acid is N, R or S, the seventh amino acid is A, G or N, and the eighth amino acid is T or V; and a VH CDR3 having an amino acid sequence of SEQ ID NO:27, wherein the first amino acid is A or T, the fifth amino acid is F or Y, and the sixth amino acid is N, G or S. In one aspect, provided herein is an antibody that binds CD8, comprising a VL CDR1 having an amino acid sequence of SEQ ID NO:28, wherein the second amino acid is A or T, the fifth amino acid is D, H or N, and the sixth amino acid is F or Y; a VL CDR2 having an amino acid sequence of SEQ ID NO:29; and a VL CDR3 having an amino acid sequence of SEQ ID NO:30, wherein the second amino acid is N or S. In one aspect, provided herein is an antibody that binds CD8, comprising a VH CDR1 having an amino acid sequence of SEQ ID NO:25, wherein the third amino acid is S or T; a VH CDR2 having an amino acid sequence of SEQ ID NO:26, wherein the first amino acid is I or V, the fourth amino acid is N, R or S, the seventh amino acid is A, G or N, and the eighth amino acid is T or V; a VH CDR3 having an amino acid sequence of SEQ ID NO:27, wherein the first amino acid is A or T, the fifth amino acid is F or Y, and the sixth amino acid is N, G or S; a VL CDR1 having an amino acid sequence of SEQ ID NO:28, wherein the second amino acid is A or T, the fifth amino acid is D, H or N, and the sixth amino acid is F or Y; a VL CDR2 having an amino acid sequence of SEQ ID NO:29; and a VL CDR3 having an amino acid sequence of SEQ ID NO:30, wherein the second amino acid is N or S.

In one aspect, provided herein is an antibody that binds CD8, comprising a VH CDR1 having an amino acid sequence of SEQ ID NO:229; a VH CDR2 having an amino acid sequence of SEQ ID NO:230; and a VH CDR3 having an amino acid sequence of SEQ ID NO:231, wherein the ninth amino acid is H or Y. In one aspect, provided herein is an antibody that binds CD8, comprising a VL CDR1 having an amino acid sequence of SEQ ID NO:232, wherein the fourth amino acid is N, R, or S, and the fifth amino acid is I or P; a VL CDR2 having an amino acid sequence of SEQ ID NO:233, wherein the first amino acid is F, H or Y; and a VL CDR3 having an amino acid sequence of SEQ ID NO:234. In one aspect, provided herein is an antibody that binds CD8, comprising: a VH CDR1 having an amino acid sequence of SEQ ID NO:229; a VH CDR2 having an amino acid sequence of SEQ ID NO:230; a VH CDR3 having an amino acid sequence of SEQ ID NO:231, wherein the ninth amino acid is H or Y; a VL CDR1 having an amino acid sequence of SEQ ID NO:232, wherein the fourth amino acid is N, R, or S, and the fifth amino acid is I or P; a VL CDR2 having an amino acid sequence of SEQ ID NO:233, wherein the first amino acid is F, H or Y; and a VL CDR3 having an amino acid sequence of SEQ ID NO:234.

In one aspect, provided herein is an antibody that binds CD8, comprising a VH CDR1 having an amino acid sequence of SEQ ID NO:365, wherein the third amino acid is I or T; a VH CDR2 having an amino acid sequence of SEQ ID NO:366, wherein the seventh amino acid is D or I; and a VH CDR3 having an amino acid sequence of SEQ ID NO:367, wherein the ninth amino acid is H or Y. In one aspect, provided herein is an antibody that binds CD8, comprising a VL CDR1 having an amino acid sequence of SEQ ID NO:368, wherein the fourth amino acid is D or G, and the fifth amino acid is K or T; a VL CDR2 having an amino acid sequence of SEQ ID NO:369; and a VL CDR3 having an amino acid sequence of SEQ ID NO:370, wherein the fifth amino acid is S or T and the eighth amino acid is S or T. In one aspect, provided herein is an antibody that binds CD8, comprising a VH CDR1 having an amino acid sequence of SEQ ID NO:365, wherein the third amino acid is I or T; a VH CDR2 having an amino acid sequence of SEQ ID NO:366, wherein the seventh amino acid is D or I; a VH CDR3 having an amino acid sequence of SEQ ID NO:367, wherein the ninth amino acid is H or Y; a VL CDR1 having an amino acid sequence of SEQ ID NO:368, wherein the fourth amino acid is D or G, and the fifth amino acid is K or T; a VL CDR2 having an amino acid sequence of SEQ ID NO:369; and a VL CDR3 having an amino acid sequence of SEQ ID NO:370, wherein the fifth amino acid is S or T and the eighth amino acid is S or T.

In one aspect, provided herein is an antibody that binds CD8, comprising a VH CDR1 having an amino acid sequence of SEQ ID NO:501, wherein the sixth amino acid is E or V; a VH CDR2 having an amino acid sequence of SEQ ID NO:502, wherein the fifth amino acid is N, S or T, the seventh amino acid is N or S, and the eighth amino acid is I or M; and a VH CDR3 having an amino acid sequence of SEQ ID NO:503, wherein the third amino acid is H or Y, and the twelfth amino acid is A or N. In one aspect, provided herein is an antibody that binds CD8, comprising a VL CDR1 having an amino acid sequence of SEQ ID NO:504;

a VL CDR2 having an amino acid sequence of SEQ ID NO:505; and a VL CDR3 having an amino acid sequence of SEQ ID NO:506, wherein the fifth amino acid is N or S, and the eighth amino acid is F or Y. In one aspect, provided herein is an antibody that binds CD8, comprising a VH CDR1 having an amino acid sequence of SEQ ID NO:501, wherein the sixth amino acid is E or V; a VH CDR2 having an amino acid sequence of SEQ ID NO:502, wherein the fifth amino acid is N, S or T, the seventh amino acid is N or S, and the eighth amino acid is I or M; a VH CDR3 having an amino acid sequence of SEQ ID NO:503, wherein the third amino acid is H or Y, and the twelfth amino acid is A or N; a VL CDR1 having an amino acid sequence of SEQ ID NO:504; a VL CDR2 having an amino acid sequence of SEQ ID NO:505; and a VL CDR3 having an amino acid sequence of SEQ ID NO:506, wherein the fifth amino acid is N or S, and the eighth amino acid is F or Y.

In one aspect, provided herein is an antibody that binds CD8, comprising a VH CDR1 having an amino acid sequence of SEQ ID NO:773, wherein the fifth amino acid is A or T, and the sixth amino acid is A or S; a VH CDR2 having an amino acid sequence of SEQ ID NO:774, wherein the first amino acid is I or V, the fourth amino acid is S or T, and the sixth amino acid is G, S or Y; and a VH CDR3 having an amino acid sequence of SEQ ID NO:775, wherein the first amino acid is A or S, the seventh amino acid is N or Y, the fourteenth amino acid is C or F, and the fifteenth amino acid is A or P. In one aspect, provided herein is an antibody that binds CD8, comprising a VL CDR1 having an amino acid sequence of SEQ ID NO:776, wherein the first amino acid is A or D; a VL CDR2 having an amino acid sequence of SEQ ID NO:777, wherein the third amino acid is E or K; and a VL CDR3 having an amino acid sequence of SEQ ID NO:778, wherein the fifth amino acid is N or T, and the sixth amino acid is N, S or T. In one aspect, provided herein is an antibody that binds CD8, comprising a VH CDR1 having an amino acid sequence of SEQ ID NO:773, wherein the fifth amino acid is A or T, and the sixth amino acid is A or S; a VH CDR2 having an amino acid sequence of SEQ ID NO:774, wherein the first amino acid is I or V, the fourth amino acid is S or T, and the sixth amino acid is G, S or Y; a VH CDR3 having an amino acid sequence of SEQ ID NO:775, wherein the first amino acid is A or S, the seventh amino acid is N or Y, the fourteenth amino acid is C or F, and the fifteenth amino acid is A or P; a VL CDR1 having an amino acid sequence of SEQ ID NO:776, wherein the first amino acid is A or D; a VL CDR2 having an amino acid sequence of SEQ ID NO:777, wherein the third amino acid is E or K; and a VL CDR3 having an amino acid sequence of SEQ ID NO:778, wherein the fifth amino acid is N or T, and the sixth amino acid is N, S or T.

In one aspect, provided herein is an antibody that binds CD8, comprising a VH CDR1 having an amino acid sequence of SEQ ID NO:841; a VH CDR2 having an amino acid sequence of SEQ ID NO:842; and a VH CDR3 having an amino acid sequence of SEQ ID NO:843, wherein the tenth amino acid is H or Y. In one aspect, provided herein is an antibody that binds CD8, comprising a VL CDR1 having an amino acid sequence of SEQ ID NO:844, wherein the sixth amino acid is A or D; a VL CDR2 having an amino acid sequence of SEQ ID NO:845; and a VL CDR3 having an amino acid sequence of SEQ ID NO:846, wherein the fourth amino acid is K or S, and the seventh amino acid is P or deleted. In one aspect, provided herein is an antibody that binds CD8, comprising a VH CDR1 having an amino acid sequence of SEQ ID NO:841; a VH CDR2 having an amino acid sequence of SEQ ID NO:842; a VH CDR3 having an amino acid sequence of SEQ ID NO:843, wherein the tenth amino acid is H or Y; a VL CDR1 having an amino acid sequence of SEQ ID NO:844, wherein the sixth amino acid is A or D; a VL CDR2 having an amino acid sequence of SEQ ID NO:845; and a VL CDR3 having an amino acid sequence of SEQ ID NO:846, wherein the fourth amino acid is K or S, and the seventh amino acid is P or deleted.

In one aspect, provided herein is an antibody that binds CD8, comprising a VH CDR1 having an amino acid sequence of SEQ ID NO:1011, wherein the fifth amino acid is S or T, the sixth amino acid is N, R or S, and the eighth amino acid is S or V; a VH CDR2 having an amino acid sequence of SEQ ID NO:1012, wherein the third amino acid is A, G or T, and the fourth amino acid is D or G; and a VH CDR3 having an amino acid sequence of SEQ ID NO:1013, wherein the second amino acid is K or R, the third amino acid is H, I or N, the fourth amino acid is N, S or Y, the fifth amino acid is F, G or Y, the sixth amino acid is D or Y, the seventh amino acid is F, N or S, the eighth amino acid is F, P or Y, the ninth amino acid is A, D or V, the tenth amino acid is A, G or F, and the twelfth amino acid is A or D. In one aspect, provided herein is an antibody that binds CD8, comprising a VL CDR1 having an amino acid sequence of SEQ ID NO:1014, wherein the second amino acid is D or N, the fourth amino acid is D, G or N, and the sixth amino acid is D or V; a VL CDR2 having an amino acid sequence of SEQ ID NO:1015, wherein the first amino acid is S or W, and the second amino acid is A or T; and a VL CDR3 having an amino acid sequence of SEQ ID NO:1016. wherein the third amino acid is C or Y, the fourth amino acid is N or S, and the eighth amino acid is L or Y. In one aspect, provided herein is an antibody that binds CD8, comprising a VH CDR1 having an amino acid sequence of SEQ ID NO:1011, wherein the fifth amino acid is S or T, the sixth amino acid is N, R or S, and the eighth amino acid is S or V; a VH CDR2 having an amino acid sequence of SEQ ID NO:1012, wherein the third amino acid is A, G or T, and the fourth amino acid is D or G; a VH CDR3 having an amino acid sequence of SEQ ID NO:1013, wherein the second amino acid is K or R, the third amino acid is H, I or N, the fourth amino acid is N, S or Y, the fifth amino acid is F, G or Y, the sixth amino acid is D or Y, the seventh amino acid is F, N or S, the eighth amino acid is F, P or Y, the ninth amino acid is A, D or V, the tenth amino acid is A, G or F, and the twelfth amino acid is A or D; a VL CDR1 having an amino acid sequence of SEQ ID NO:1014, wherein the second amino acid is D or N, the fourth amino acid is D, G or N, and the sixth amino acid is D or V; a VL CDR2 having an amino acid sequence of SEQ ID NO:1015, wherein the first amino acid is S or W, and the second amino acid is A or T; and a VL CDR3 having an amino acid sequence of SEQ ID NO:1016. wherein the third amino acid is C or Y, the fourth amino acid is N or S, and the eighth amino acid is L or Y.

In one aspect, provided herein is an antibody that binds CD8, comprising a VH CDR1 having an amino acid sequence of SEQ ID NO:1045; a VH CDR2 having an amino acid sequence of SEQ ID NO:1046; and a VH CDR3 having an amino acid sequence of SEQ ID NO:1047, wherein the first amino acid is A or S. In one aspect, provided herein is an antibody that binds CD8, comprising a VL CDR1 having an amino acid sequence of SEQ ID NO:1048; a VL CDR2 having an amino acid sequence of SEQ ID NO:1049; and a VL CDR3 having an amino acid sequence of SEQ ID NO:1050. In one aspect, provided herein is an antibody that binds CD8, comprising a VH CDR1 having an amino acid sequence of SEQ ID NO:1045; a VH CDR2 having an amino acid sequence of SEQ ID NO:1046; a VH CDR3 having an amino acid sequence of SEQ ID NO:1047, wherein the first amino acid is A or S; a VL CDR1 having an amino acid sequence of SEQ ID NO:1048; a VL CDR2 having an amino acid sequence of SEQ ID NO: 1049; and a VL CDR3 having an amino acid sequence of SEQ ID NO:1050.

In one aspect, provided herein is an antibody that binds CD8, comprising a VH CDR1 having an amino acid sequence of SEQ ID NO:1181, wherein the second amino acid is F or Y, the third amino acid is S or T, the fourth amino acid is F or L, and the eighth amino acid is A or W; a VH CDR2 having an amino acid sequence of SEQ ID NO:1182, wherein the second amino acid is D or W, the third amino acid is P or T, the fourth amino acid is D or S, the fifth amino acid is D or G, the sixth amino acid is S or T, and the seventh amino acid is F or deleted; and a VH CDR3 having an amino acid sequence of SEQ ID NO:1183, wherein the third amino acid is G or N, the fourth amino acid is D or N, the fifth amino acid is G or W, the sixth amino acid is D or Y, the seventh amino acid is F or R, the eighth amino acid is D or P, the ninth amino acid is A or W, the tenth amino acid is F or Y, the twelfth amino acid is A or D, and the thirteenth amino acid is V or Y. In one aspect, provided herein is an antibody that binds CD8, comprising a VL CDR1 having an amino acid sequence of SEQ ID NO:1184, wherein the second amino acid is S or T, the third amino acid is I or L, the fourth amino acid is L or V, the fifth amino acid is H or Y, the seventh amino acid is D or N, and the ninth amino acid is K or N; a VL CDR2 having an amino acid sequence of SEQ ID NO:1185, wherein the first amino acid is K or L; and a VL CDR3 having an amino acid sequence of SEQ ID NO:1186, wherein the first amino acid is F or L, the third amino acid is A or G, the fourth amino acid is S or T, the sixth amino acid is A or F, and the eighth amino acid is F or H. In one aspect, provided herein is an antibody that binds CD8, comprising a VH CDR1 having an amino acid sequence of SEQ ID NO:1181, wherein the second amino acid is F or Y, the third amino acid is S or T, the fourth amino acid is F or L, and the eighth amino acid is A or W; a VH CDR2 having an amino acid sequence of SEQ ID NO:1182, wherein the second amino acid is D or W, the third amino acid is P or T, the fourth amino acid is D or S, the fifth amino acid is D or G, the sixth amino acid is S or T, and the seventh amino acid is F or deleted; a VH CDR3 having an amino acid sequence of SEQ ID NO:1183, wherein the third amino acid is G or N, the fourth amino acid is D or N, the fifth amino acid is G or W, the sixth amino acid is D or Y, the seventh amino acid is F or R, the eighth amino acid is D or P, the ninth amino acid is A or W, the tenth amino acid is F or Y, the twelfth amino acid is A or D, and the thirteenth amino acid is V or Y; a VL CDR1 having an amino acid sequence of SEQ ID NO:1184, wherein the second amino acid is S or T, the third amino acid is I or L, the fourth amino acid is L or V, the fifth amino acid is H or Y, the seventh amino acid is D or N, and the ninth amino acid is K or N; a VL CDR2 having an amino acid sequence of SEQ ID NO:1185, wherein the first amino acid is K or L; and a VL CDR3 having an amino acid sequence of SEQ ID NO:1186, wherein the first amino acid is F or L, the third amino acid is A or G, the fourth amino acid is S or T, the sixth amino acid is A or F, and the eighth amino acid is F or H.

In one aspect, provided herein is an antibody that binds CD8, comprising a VH CDR1 having an amino acid sequence of SEQ ID NO:1283; a VH CDR2 having an amino acid sequence of SEQ ID NO:1284; and a VH CDR3 having an amino acid sequence of SEQ ID NO:1285, wherein the first amino acid is A or T, the sixth amino acid is A or P, the ninth amino acid is H or R, and the fourteenth amino acid is D or V. In one aspect, provided herein is an antibody that binds CD8, comprising a VL CDR1 having an amino acid sequence of SEQ ID NO:1286; a VL CDR2 having an amino acid sequence of SEQ ID NO:1287; and a VL CDR3 having an amino acid sequence of SEQ ID NO:1288, wherein the first amino acid is I or S. In one aspect, provided herein is an antibody that binds CD8, comprising a VH CDR1 having an amino acid sequence of SEQ ID NO:1283; a VH CDR2 having an amino acid sequence of SEQ ID NO:1284; a VH CDR3 having an amino acid sequence of SEQ ID NO:1285, wherein the first amino acid is A or T, the sixth amino acid is A or P, the ninth amino acid is H or R, and the fourteenth amino acid is D or V; a VL CDR1 having an amino acid sequence of SEQ ID NO: 1286; a VL CDR2 having an amino acid sequence of SEQ ID NO:1287; and a VL CDR3 having an amino acid sequence of SEQ ID NO:1288, wherein the first amino acid is I or S.

In one aspect, provided herein is an antibody that binds CD8, comprising a VH CDR1 having an amino acid sequence of SEQ ID NO:1385, wherein the fifth amino acid is N or S; a VH CDR2 having an amino acid sequence of SEQ ID NO:1386, wherein the seventh amino acid is K or R; and a VH CDR3 having an amino acid sequence of SEQ ID NO:1387, wherein the fourth amino acid is D or V. In one aspect, provided herein is an antibody that binds CD8, comprising a VL CDR1 having an amino acid sequence of SEQ ID NO:1388; a VL CDR2 having an amino acid sequence of SEQ ID NO:1389; and a VL CDR3 having an amino acid sequence of SEQ ID NO:1390. In one aspect, provided herein is an antibody that binds CD8, comprising a VH CDR1 having an amino acid sequence of SEQ ID NO:1385, wherein the fifth amino acid is N or S; a VH CDR2 having an amino acid sequence of SEQ ID NO:1386, wherein the seventh amino acid is K or R; a VH CDR3 having an amino acid sequence of SEQ ID NO:1387, wherein the fourth amino acid is D or V; a VL CDR1 having an amino acid sequence of SEQ ID NO:1388; a VL CDR2 having an amino acid sequence of SEQ ID NO:1389; and a VL CDR3 having an amino acid sequence of SEQ ID NO:1390.

In one aspect, provided herein is an antibody that binds CD8, comprising a VH CDR1 having an amino acid sequence of SEQ ID NO:1419, wherein the third amino acid is S or T, the fourth amino acid is F or S, the fifth amino acid is A or T, the sixth amino acid is S or N, and the seventh amino acid is F, H or Y; a VH CDR2 having an amino acid sequence of SEQ ID NO:1420, wherein the fourth amino acid is F or G, the sixth amino acid is D or S, and the eighth amino acid is S or T; and a VH CDR3 having an amino acid sequence of SEQ ID NO:1421, wherein the third amino acid is E or H, the fourth amino acid is E or S, the fifth amino acid is A, F, P or Y, the sixth amino acid is D, G or S, the seventh amino acid is H or Y, the eighth amino acid is F, K, R, or Y, the ninth amino acid is D, P, S, or Y, the tenth amino acid is S, T, or Y, the eleventh amino acid is A or W, the twelfth amino acid is M or F, and the thirteenth amino acid is A, D or V. In one aspect, provided herein is an antibody that binds CD8, comprising a VL CDR1 having an amino acid sequence of SEQ ID NO:1422, wherein the fifth amino acid is I or T; a VL CDR2 having an amino acid sequence of SEQ ID NO:1423; and a VL CDR3 having an amino acid sequence of SEQ ID NO:1424, wherein the fifth amino acid is S or T, the sixth amino acid is D or Y, and the eighth amino acid is F, L, or Y. In one aspect, provided herein is an antibody that binds CD8, comprising a VH CDR1 having an amino acid sequence of SEQ ID NO:1419, wherein the third amino acid is S or T, the fourth amino acid is F or S, the fifth amino acid is A or T, the sixth amino acid is S or N, and the seventh amino acid is F, H or Y; a VH CDR2 having an amino acid sequence of SEQ ID NO:1420, wherein the fourth amino acid is F or G, the sixth amino acid is D or S, and the eighth amino acid is S or T; a VH CDR3 having an amino acid sequence of SEQ ID NO:1421, wherein the third amino acid is E or H, the fourth amino acid is E or S, the fifth amino acid is A, F, P or Y, the sixth amino acid is D, G or S, the seventh amino acid is H or Y, the eighth amino acid is F, K, R, or Y, the ninth amino acid is D, P, S, or Y, the tenth amino acid is S, T, or Y, the eleventh amino acid is A or W, the twelfth amino acid is M or F, and the thirteenth amino acid is A, D or V; a VL CDR1 having an amino acid sequence of SEQ ID NO:1422, wherein the fifth amino acid is I or T; a VL CDR2 having an amino acid sequence of SEQ ID NO:1423; and a VL CDR3 having an amino acid sequence of SEQ ID NO:1424, wherein the fifth amino acid is S or T, the sixth amino acid is D or Y, and the eighth amino acid is F, L, or Y.

In one aspect, provided herein is an antibody that binds CD8, comprising a VH CDR1 having an amino acid sequence of SEQ ID NO:1759, wherein the third amino acid is S or T, the sixth amino acid is S or T, the seventh amino acid is A or Y, and the eighth amino acid is G or Y; a VH CDR2 having an amino acid sequence of SEQ ID NO:1760, wherein the second amino acid is D or N, the third amino acid is P or T, the fourth amino acid is F or H, the fifth amino acid is A or N, the seventh amino acid is E or N, and the eight amino acid is S or T; and a VH CDR3 having an amino acid sequence of SEQ ID NO:1761, wherein the second amino acid is R or S, the third amino acid is P or S, the fourth amino acid is G or N, the fifth amino acid is D or S, the sixth amino acid is N or Y, the seventh amino acid is D or Y, the eighth amino acid is G or V, the ninth amino acid is G or S, the tenth amino acid is H or T, and the eleventh amino acid is P or W. In one aspect, provided herein is an antibody that binds CD8, comprising a VL CDR1 having an amino acid sequence of SEQ ID NO:1762, wherein the second amino acid is D or N, the fourth amino acid is N or R, the fifth amino acid is P or V, and the sixth amino acid is W or Y; a VL CDR2 having an amino acid sequence of SEQ ID NO:1763, wherein the first amino acid is K or Y, and the second amino acid is A or T; and a VL CDR3 having an amino acid sequence of SEQ ID NO:1764, wherein the first amino acid is D or G, the fourth amino acid is N or Q, the fifth amino acid is S or T, the sixth amino acid is F or L, and the eight amino acid is F or Y. In one aspect, provided herein is an antibody that binds CD8, comprising a VH CDR1 having an amino acid sequence of SEQ ID NO:1759, wherein the third amino acid is S or T, the sixth amino acid is S or T, the seventh amino acid is A or Y, and the eighth amino acid is G or Y; a VH CDR2 having an amino acid sequence of SEQ ID NO:1760, wherein the second amino acid is D or N, the third amino acid is P or T, the fourth amino acid is F or H, the fifth amino acid is A or N, the seventh amino acid is E or N, and the eight amino acid is S or T; a VH CDR3 having an amino acid sequence of SEQ ID NO:1761, wherein the second amino acid is R or S, the third amino acid is P or S, the fourth amino acid is G or N, the fifth amino acid is D or S, the sixth amino acid is N or Y, the seventh amino acid is D or Y, the eighth amino acid is G or V, the ninth amino acid is G or S, the tenth amino acid is H or T, and the eleventh amino acid is P or W; a VL CDR1 having an amino acid sequence of SEQ ID NO:1762, wherein the second amino acid is D or N, the fourth amino acid is N or R, the fifth amino acid is P or V, and the sixth amino acid is W or Y; a VL CDR2 having an amino acid sequence of SEQ ID NO:1763, wherein the first amino acid is K or Y, and the second amino acid is A or T; and a VL CDR3 having an amino acid sequence of SEQ ID NO:1764, wherein the first amino acid is D or G, the fourth amino acid is N or Q, the fifth amino acid is S or T, the sixth amino acid is F or L, and the eight amino acid is F or Y.

In one aspect, provided herein is an antibody that binds CD8, comprising a VH CDR1 having an amino acid sequence of SEQ ID NO:1827, wherein the third amino acid is K or T; a VH CDR2 having an amino acid sequence of SEQ ID NO:1828; and a VH CDR3 having an amino acid sequence of SEQ ID NO:1829. In one aspect, provided herein is an antibody that binds CD8, comprising a VL CDR1 having an amino acid sequence of SEQ ID NO:1830; a VL CDR2 having an amino acid sequence of SEQ ID NO:1831, wherein the second amino acid is A or T; and a VL CDR3 having an amino acid sequence of SEQ ID NO:1832, wherein the fifth amino acid is I or S. In one aspect, provided herein is an antibody that binds CD8, comprising a VH CDR1 having an amino acid sequence of SEQ ID NO:1827, wherein the third amino acid is K or T; a VH CDR2 having an amino acid sequence of SEQ ID NO:1828; and a VH CDR3 having an amino acid sequence of SEQ ID NO:1829; a VL CDR1 having an amino acid sequence of SEQ ID NO:1830; a VL CDR2 having an amino acid sequence of SEQ ID NO:1831, wherein the second amino acid is A or T; and a VL CDR3 having an amino acid sequence of SEQ ID NO:1832, wherein the fifth amino acid is I or S.

In another aspect, provided herein is an antibody that competes for binding to CD8 with any of the CD8 antibodies described herein. In another aspect, provided herein is an antibody that binds to the same epitope as any of the CD8 antibodies described herein. In another aspect, provided is a CD8 antibody that binds an epitope on CD8 that overlaps with the epitope on CD8 bound by a CD8 antibody described herein.

In one aspect, provided is an antibody that competes for binding to CD8 with a CD8 reference antibody. In another aspect, provided is a CD8 antibody that binds to the same CD8 epitope as a CD8 reference antibody. In another aspect, provided is a CD8 antibody that binds an epitope on CD8 that overlaps with the epitope on CD8 bound by a CD8 reference antibody. In one embodiment, the CD8 reference antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:31; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:32. In one embodiment, the CD8 reference antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:65; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:66. In one embodiment, the CD8 reference antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:99; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:100. In one embodiment, the CD8 reference antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:133; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:134. In one embodiment, the CD8 reference antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:167; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:168. In one embodiment, the CD8 reference antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:201; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:202. In one embodiment, the CD8 reference antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:235; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:236. In one embodiment, the CD8 reference antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:269; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:270. In one embodiment, the CD8 reference antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:303; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:304. In one embodiment, the CD8 reference antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:337; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:338. In one embodiment, the CD8 reference antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:371; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:372. In one embodiment, the CD8 reference antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:405; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:406. In one embodiment, the CD8 reference antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:439; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:440. In one embodiment, the CD8 reference antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:473; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:474. In one embodiment, the CD8 reference antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:507; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:508. In one embodiment, the CD8 reference antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:541; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:542. In one embodiment, the CD8 reference antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:575; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:576. In one embodiment, the CD8 reference antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:609; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:610. In one embodiment, the CD8 reference antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:643; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:644. In one embodiment, the CD8 reference antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:677; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:678. In one embodiment, the CD8 reference antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:711; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:712. In one embodiment, the CD8 reference antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:745; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:746. In one embodiment, the CD8 reference antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:779; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:780. In one embodiment, the CD8 reference antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:813; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:814. In one embodiment, the CD8 reference antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:847; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:848. In one embodiment, the CD8 reference antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:881; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:882. In one embodiment, the CD8 reference antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:915; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:916. In one embodiment, the CD8 reference antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:949; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:950. In one embodiment, the CD8 reference antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:983; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:984. In one embodiment, the CD8 reference antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1017; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1018. In one embodiment, the CD8 reference antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1051; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1052. In one embodiment, the CD8 reference antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1085; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1086. In one embodiment, the CD8 reference antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1119; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1120. In one embodiment, the CD8 reference antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1153; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1154. In one embodiment, the CD8 reference antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1187; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1188. In one embodiment, the CD8 reference antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1221; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1222. In one embodiment, the CD8 reference antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1255; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1256. In one embodiment, the CD8 reference antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1289; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1290. In one embodiment, the CD8 reference antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1323; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1324. In one embodiment, the CD8 reference antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1357; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1358. In one embodiment, the CD8 reference antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1391; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1392. In one embodiment, the CD8 reference antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1425; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1426. In one embodiment, the CD8 reference antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1459; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1460. In one embodiment, the CD8 reference antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1493; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1494. In one embodiment, the CD8 reference antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1527; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1528. In one embodiment, the CD8 reference antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1561; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1562. In one embodiment, the CD8 reference antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1595; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1596. In one embodiment, the CD8 reference antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1629; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1630. In one embodiment, the CD8 reference antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1663; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1664. In one embodiment, the CD8 reference antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1697; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1698. In one embodiment, the CD8 reference antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1731; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1732. In one embodiment, the CD8 reference antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1765; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1766. In one embodiment, the CD8 reference antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1799; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1800. In one embodiment, the CD8 reference antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1833; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1834. In one embodiment, the CD8 reference antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1867; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1868. In one embodiment, the CD8 reference antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1901; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1902. In one embodiment, the CD8 reference antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1935; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1936. In one embodiment, the CD8 reference antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1969; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1970. In one embodiment, the CD8 reference antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2003; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2004. In another aspect, provided herein is an antibody that binds CD8. In one embodiment, the CD8 reference antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2037; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2038. In one embodiment, the CD8 reference antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2071; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2072. In one embodiment, the CD8 reference antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2105; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2106. In one embodiment, the CD8 reference antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2139; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2140. In one embodiment, the CD8 reference antibody comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2173; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2174.

In another aspect, provided herein is a multispecific antibody that binds CD8. In some embodiments, the multispecific antibody is a bispecific antibody. In some embodiments, the multispecific antibody is a trispecific antibody. In some embodiments, the multispecific antibody is a quadraspecific antibody. In one embodiment, the multispecific CD8 antibody comprises: (a) a first binding domain that binds CD8, and (b) a second binding domain that binds to a second target. In one embodiment, the multispecific CD8 antibody comprises: (a) a first binding domain that binds CD8, and (b) a second binding domain that binds to a second target, and (c) a third binding domain that binds to a third target. In one embodiment, the multispecific CD8 antibody comprises: (a) a first binding domain that binds CD8, and (b) a second binding domain that binds to a second target, (c) a third binding domain that binds to a third target, and (d) a fourth binding domain that binds to a fourth target.

In one embodiment, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:31; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:32. In one embodiment, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:65; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:66. In one embodiment, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:99; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:100. In one embodiment, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:133; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:134. In one embodiment, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:167; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:168. In one embodiment, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:201; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:202. In one embodiment, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:235; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:236. In one embodiment, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:269; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:270. In one embodiment, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:303; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:304. In one embodiment, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:337; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:338. In one embodiment, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:371; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:372. In one embodiment, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:405; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:406. In one embodiment, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:439; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:440. In one embodiment, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:473; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:474. In one embodiment, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:507; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:508. In one embodiment, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:541; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:542. In one embodiment, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:575; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:576. In one embodiment, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:609; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:610. In one embodiment, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:643; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:644. In one embodiment, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:677; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:678. In one embodiment, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:711; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:712. In one embodiment, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:745; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:746. In one embodiment, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:779; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:780. In one embodiment, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:813; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:814. In one embodiment, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:847; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:848. In one embodiment, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:881; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:882. In one embodiment, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:915; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:916. In one embodiment, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:949; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:950. In one embodiment, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:983; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:984. In one embodiment, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1017; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1018. In one embodiment, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1051; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1052. In one embodiment, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1085; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1086. In one embodiment, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1119; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1120. In one embodiment, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1153; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1154. In one embodiment, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1187; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1188. In one embodiment, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1221; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1222. In one embodiment, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1255; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1256. In one embodiment, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1289; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1290. In one embodiment, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1323; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1324. In one embodiment, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1357; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1358. In one embodiment, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1391; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1392. In one embodiment, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1425; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1426. In one embodiment, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1459; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1460. In one embodiment, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1493; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1494. In one embodiment, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1527; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1528. In one embodiment, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1561; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1562. In one embodiment, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1595; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1596. In one embodiment, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1629; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1630. In one embodiment, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1663; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1664. In one embodiment, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1697; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1698. In one embodiment, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1731; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1732. In one embodiment, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1765; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1766. In one embodiment, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1799; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1800. In one embodiment, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1833; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1834. In one embodiment, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1867; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1868. In one embodiment, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1901; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1902. In one embodiment, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1935; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1936. In one embodiment, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1969; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1970. In one embodiment, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2003; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2004. In another aspect, provided herein is an antibody that binds CD8. In one embodiment, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2037; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2038. In one embodiment, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2071; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2072. In one embodiment, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2105; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2106.

In one embodiment, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2139; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2140. In one embodiment, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2173; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2174.

In some embodiments, the VH CDR1, VH CDR2, VH CDR3, VL CDR1, VL CDR2, and VL CDR3 amino acid sequences of the first binding domain that binds CD8 are according to the Kabat numbering system. In some embodiments, the VH CDR1, VH CDR2, VH CDR3, VL CDR1, VL CDR2, and VL CDR3 amino acid sequences of the first binding domain that binds CD8 are according to the Chothia numbering system. In some embodiments, the VH CDR1, VH CDR2, VH CDR3, VL CDR1, VL CDR2, and VL CDR3 amino acid sequences of the first binding domain that binds CD8 are according to the AbM numbering system. In some embodiments, the VH CDR1, VH CDR2, VH CDR3, VL CDR1, VL CDR2, and VL CDR3 amino acid sequences of the first binding domain that binds CD8 are according to the Contact numbering system. In some embodiments, the VH CDR1, VH CDR2, VH CDR3, VL CDR1, VL CDR2, and VL CDR3 amino acid sequences of the first binding domain that binds CD8 are according to the IMGT numbering system.

In some embodiments, the first binding domain binds a CD8 antigen. In some embodiments, the first binding domain binds a CD8 epitope. In some embodiments, the first binding domain specifically binds to CD8. In some embodiments, the VH CDR1, VH CDR2, VH CDR3, VL CDR1, VL CDR2 and VL CDR3 of the first binding domain form a binding site for an antigen of the CD8. In some embodiments, the VH CDR1, VH CDR2, VH CDR3, VL CDR1, VL CDR2 and VL CDR3 of the first binding domain form a binding site for an epitope of the CD8. In some embodiments, the CD8 is present on the surface of a T cell. In some embodiments, the first binding domain binds to CD8α. In some embodiments, the first binding domain binds a CD8α antigen. In some embodiments, the first binding domain that binds a CD8α epitope. In some embodiments, the first binding domain specifically binds to CD8α. In some embodiments, the VH CDR1, VH CDR2, VH CDR3, VL CDR1, VL CDR2 and VL CDR3 of the first binding domain form a binding site for an antigen of the CD8α. In some embodiments, the VH CDR1, VH CDR2, VH CDR3, VL CDR1, VL CDR2 and VL CDR3 of the first binding domain form a binding site for an epitope of the CD8α. In some embodiments, the CD8α is present on the surface of a T cell. In some embodiments, the first binding domain binds to CD8β. In some embodiments, the first binding domain binds a CD8β antigen. In some embodiments, the first binding domain that binds a CD8β epitope. In some embodiments, the first binding domain specifically binds to CD8β. In some embodiments, the VH CDR1, VH CDR2, VH CDR3, VL CDR1, VL CDR2 and VL CDR3 of the first binding domain form a binding site for an antigen of the CD8β. In some embodiments, the VH CDR1, VH CDR2, VH CDR3, VL CDR1, VL CDR2 and VL CDR3 of the first binding domain form a binding site for an epitope of the CD8β. In some embodiments, the CD8β is present on the surface of a T cell. In some embodiments, the first binding domain binds at the interface of CD8α and CD8β. In some embodiments, the first binding domain binds an antigen at the interface of CD8α and CD8β. In some embodiments, first binding domain binds an epitope at the interface of CD8α and CD8β. In some embodiments, the first binding domain specifically binds at the interface of CD8α and CD8β. In some embodiments, the VH CDR1, VH CDR2, VH CDR3, VL CDR1, VL CDR2 and VL CDR3 of the first binding domain form a binding site for an antigen at the interface of CD8α and CD8β. In some embodiments, the VH CDR1, VH CDR2, VH CDR3, VL CDR1, VL CDR2 and VL CDR3 of the first binding domain form a binding site for an epitope at the interface of CD8α and CD8β. In some embodiments, the interface of CD8α and CD8β is present on the surface of a T cell.

In some embodiments of the multispecific CD8 antibodies provided herein, the second target is not a CD8 antigen. In some embodiments of the multispecific CD8 antibodies provided herein, the third target is not a CD8 antigen. In some embodiments of the multispecific CD8 antibodies provided herein, the fourth target is not a CD8 antigen. In some embodiments of the multispecific CD8 antibodies provided herein, the second target is not a CD8 antigen, and the third target is not a CD8 antigen. In some embodiments of the multispecific CD8 antibodies provided herein, the second target is not a CD8 antigen, and the fourth target is not a CD8 antigen. In some embodiments of the multispecific CD8 antibodies provided herein, the third target is not a CD8 antigen, and the fourth target is not a CD8 antigen. In some embodiments of the multispecific CD8 antibodies provided herein, the second target is not a CD8 antigen, the third target is not a CD8 antigen, and the fourth target is not a CD8 antigen. In some embodiments of the multispecific CD8 antibodies provided herein, the second target is not a CD8 epitope. In some embodiments of the multispecific CD8 antibodies provided herein, the third target is not a CD8 epitope. In some embodiments of the multispecific CD8 antibodies provided herein, the fourth target is not a CD8 epitope. In some embodiments of the multispecific CD8 antibodies provided herein, the second target is not a CD8 epitope, and the third target is not a CD8 epitope. In some embodiments of the multispecific CD8 antibodies provided herein, the second target is not a CD8 epitope, and the fourth target is not a CD8 epitope. In some embodiments of the multispecific CD8 antibodies provided herein, the third target is not a CD8 epitope, and the fourth target is not a CD8 epitope. In some embodiments of the multispecific CD8 antibodies provided herein, the second target is not a CD8 epitope, the third target is not a CD8 epitope, and the fourth target is not a CD8 epitope.

In some embodiments of the multispecific CD8 antibodies provided herein, the second target is CD4. In some embodiments of the multispecific CD8 antibodies provided herein, the second target is a T cell receptor (TCR) complex. As used herein, "TCR complex" refers to a known TCR complex comprising TCRα and TCRβ chains, CD3ε, CD3γ, CD3δ, and CD3ζ molecules. In certain embodiments, TCRα and TCRβ chains are replaced by TCRγ and TCRδ chains. The amino acid sequences of the various proteins forming the TCR complex are known. In some embodiments of the multispecific CD8 antibodies provided herein, the second target is CD3. In some embodiments, CD3 comprises CD3ε. In some embodiments, CD3 comprises CD3γ. In some embodiments, CD3 comprises CD3δ. In some embodiments, CD3 comprises CD3ζ. In some embodiments of the multispecific CD8 antibodies provided herein, the second target is CD3ε. In some embodiments of the multispecific CD8 antibodies provided herein, the second target is CD3γ. In some embodiments of the multispecific CD8 antibodies provided herein, the second target is CD3δ. In some embodiments of the multispecific CD8 antibodies provided herein, the second target is CD3ζ. In some embodiments of the multispecific CD8 antibodies provided herein, the second target is a TCRα chain. In some embodiments of the multispecific CD8 antibodies provided herein, the second target is a TCRβ chain. In some embodiments of the multispecific CD8 antibodies provided herein, the second target is a TCRγ chain. In some embodiments of the multispecific CD8 antibodies provided herein, the second target is a TCRδ chain. In some embodiments of the multispecific CD8 antibodies provided herein, the second target is a T cell costimulatory molecule. In some embodiments of the multispecific CD8 antibodies provided herein, the second target is CD28. In some embodiments of the multispecific CD8 antibodies provided herein, the second target is CTLA4. In some embodiments of the multispecific CD8 antibodies provided herein, the second target is ICOS. In some embodiments of the multispecific CD8 antibodies provided herein, the second target is 4-1BB. In some embodiments of the multispecific CD8 antibodies provided herein, the second target is GITR. In some embodiments of the multispecific CD8 antibodies provided herein, the second target is CD27. In some embodiments of the multispecific CD8 antibodies provided herein, the second target is OX40. In some embodiments of the multispecific CD8 antibodies provided herein, the second target is CD40L. In some embodiments of the multispecific CD8 antibodies provided herein, the second target is HVEM. In some embodiments of the multispecific CD8 antibodies provided herein, the second target is Galectin-9. In some embodiments of the multispecific CD8 antibodies provided herein, the second target is TIM-1. In some embodiments of the multispecific CD8 antibodies provided herein, the second target is LFA1. In some embodiments of the multispecific CD8 antibodies provided herein, the second target is CD2. In some embodiments of the multispecific CD8 antibodies provided herein, the second target is PD1. In some embodiments of the multispecific CD8 antibodies provided herein, the third target is a TCR complex. In some embodiments of the multispecific CD8 antibodies provided herein, the third target is CD3. In some embodiments of the multispecific CD8 antibodies provided herein, the third target is CD3ε. In some embodiments of the multispecific CD8 antibodies provided herein, the third target is CD3γ. In some embodiments of the multispecific CD8 antibodies provided herein, the third target is CD3δ. In some embodiments of the multispecific CD8 antibodies provided herein, the third target is CD3ζ. In some embodiments of the multispecific CD8 antibodies provided herein, the third target is a TCRα chain. In some embodiments of the multispecific CD8 antibodies provided herein, the third target is a TCRβ chain. In some embodiments of the multispecific CD8 antibodies provided herein, the third target is a TCRγ chain. In some embodiments of the multispecific CD8 antibodies provided herein, the third target is a TCRδ chain. In some embodiments of the multispecific CD8 antibodies provided herein, the third target is a T cell costimulatory molecule. In some embodiments of the multispecific CD8 antibodies provided herein, the third target is CD28. In some embodiments of the multispecific CD8 antibodies provided herein, the third target is CTLA4. In some embodiments of the multispecific CD8 antibodies provided herein, the third target is ICOS. In some embodiments of the multispecific CD8 antibodies provided herein, the third target is 4-1BB. In some embodiments of the multispecific CD8 antibodies provided herein, the third target is GITR. In some embodiments of the multispecific CD8 antibodies provided herein, the third target is CD27. In some embodiments of the multispecific CD8 antibodies provided herein, the third target is OX40. In some embodiments of the multispecific CD8 antibodies provided herein, the third target is CD40L. In some embodiments of the multispecific CD8 antibodies provided herein, the third target is HVEM. In some embodiments of the multispecific CD8 antibodies provided herein, the third target is Galectin-9. In some embodiments of the multispecific CD8 antibodies provided herein, the third target is TIM-1. In some embodiments of the multispecific CD8 antibodies provided herein, the third target is LFA1. In some embodiments of the multispecific CD8 antibodies provided herein, the third target is CD2. In some embodiments of the multispecific CD8 antibodies provided herein, the third target is PD1. In some embodiments of the multispecific CD8 antibodies provided herein, the fourth target is a TCR complex. In some embodiments of the multispecific CD8 antibodies provided herein, the fourth target is CD3. In some embodiments of the multispecific CD8 antibodies provided herein, the fourth target is CD3ε. In some embodiments of the multispecific CD8 antibodies provided herein, the fourth target is CD3γ. In some embodiments of the multispecific CD8 antibodies provided herein, the fourth target is CD3δ. In some embodiments of the multispecific CD8 antibodies provided herein, the fourth target is CD3ζ. In some embodiments of the multispecific CD8 antibodies provided herein, the fourth target is a TCRα chain. In some embodiments of the multispecific CD8 antibodies provided herein, the fourth target is a TCRβ chain. In some embodiments of the multispecific CD8 antibodies provided herein, the fourth target is a TCRγ chain. In some embodiments of the multispecific CD8 antibodies provided herein, the fourth target is a TCRδ chain. In some embodiments of the multispecific CD8 antibodies provided herein, the fourth target is a T cell costimulatory molecule. In some embodiments of the multispecific CD8 antibodies provided herein, the fourth target is CD28. In some embodiments of the multispecific CD8 antibodies provided herein, the fourth target is CTLA4. In some embodiments of the multispecific CD8 antibodies provided herein, the fourth target is ICOS. In some embodiments of the multispecific CD8 antibodies provided herein, the fourth target is 4-1BB. In some embodiments of the multispecific CD8 antibodies provided herein, the fourth target is GITR. In some embodiments of the multispecific CD8 antibodies provided herein, the fourth target is CD27. In some embodiments of the multispecific CD8 antibodies provided herein, the fourth target is OX40. In some embodiments of the multispecific CD8 antibodies provided herein, the fourth target is CD40L. In some embodiments of the multispecific CD8 antibodies provided herein, the fourth target is HVEM. In some embodiments of the multispecific CD8 antibodies provided herein, the fourth target is Galectin-9. In some embodiments of the multispecific CD8 antibodies provided herein, the fourth target is TIM-1. In some embodiments of the multispecific CD8 antibodies provided herein, the fourth target is LFA1. In some embodiments of the multispecific CD8 antibodies provided herein, the fourth target is CD2. In some embodiments of the multispecific CD8 antibodies provided herein, the second target is HVEM. In some embodiments of the multispecific CD8 antibodies provided herein, the second target is Galectin-9. In some embodiments of the multispecific CD8 antibodies provided herein, the second target is TIM-1. In some embodiments of the multispecific CD8 antibodies provided herein, the second target is LFA1. In some embodiments of the multispecific CD8 antibodies provided herein, the second target is CD2.

In some embodiments of the multispecific CD8 antibodies provided herein, the fourth target is PD1. In some embodiments, the second target is CD4. In some embodiments of the multispecific CD8 antibodies provided herein, the third target is CD3. In some embodiments of the multispecific CD8 antibodies provided herein, the third target is TCRα chain. In some embodiments of the multispecific CD8 antibodies provided herein, the third target is a TCRβ chain. In some embodiments of the multispecific CD8 antibodies provided herein, the third target is a TCRγ chain. In some embodiments of the multispecific CD8 antibodies provided herein, the third target is a TCRδ chain. In some embodiments of the multispecific CD8 antibodies provided herein, the third target is CD28. In some embodiments of the multispecific CD8 antibodies provided herein, the fourth target is CD28.

In some embodiments of the multispecific CD8 antibodies provided herein, the second target is CD4, and the third target is a TCR complex. In some embodiments of the multispecific CD8 antibodies provided herein, the second target is CD4, and the third target is CD3. In some embodiments of the multispecific CD8 antibodies provided herein, the second target is CD4, and the third target is CD3ε. In some embodiments of the multispecific CD8 antibodies provided herein, the second target is CD4, and the third target is CD3γ. In some embodiments of the multispecific CD8 antibodies provided herein, the second target is CD4, and the third target is CD3δ. In some embodiments of the multispecific CD8 antibodies provided herein, the second target is CD4, and the third target is CD3ζ. In some embodiments of the multispecific CD8 antibodies provided herein, the second target is CD4, and the third target is a TCRα chain. In some embodiments of the multispecific CD8 antibodies provided herein, the second target is CD4, and the third target is a TCRβ chain. In some embodiments of the multispecific CD8 antibodies provided herein, the second target is CD4, and the third target is a TCRγ chain.

In some embodiments of the multispecific CD8 antibodies provided herein, the second target is CD4, and the third target is a T cell costimulatory molecule. In some embodiments of the multispecific CD8 antibodies provided herein, the second target is CD4, and the third target is CD28. In some embodiments of the multispecific CD8 antibodies provided herein, the second target is CD4, and the third target is CTLA4. In some embodiments of the multispecific CD8 antibodies provided herein, the second target is CD4, and the third target is ICOS. In some embodiments of the multispecific CD8 antibodies provided herein, the second target is CD4, and the third target is 4-1BB. In some embodiments of the multispecific CD8 antibodies provided herein, the second target is CD4, and the third target is GITR. In some embodiments of the multispecific CD8 antibodies provided herein, the second target is CD4, and the third target is CD27. In some embodiments of the multispecific CD8 antibodies provided herein, the second target is CD4, and the third target is OX40. In some embodiments of the multispecific CD8 antibodies provided herein, the second target is CD4, and the third target is CD40L. In some embodiments of the multispecific CD8 antibodies provided herein, the second target is CD4, and the third target is HVEM. In some embodiments of the multispecific CD8 antibodies provided herein, the second target is CD4, and the third target is Galectin-9. In some embodiments of the multispecific CD8 antibodies provided herein, the second target is CD4, and the third target is TIM-1. In some embodiments of the multispecific CD8 antibodies provided herein, the second target is CD4, and the third target is LFA1. In some embodiments of the multispecific CD8 antibodies provided herein, the second target is CD4, and the third target is CD2. In some embodiments of the multispecific CD8 antibodies provided herein, the second target is CD4, and the third target is PD1.

In some embodiments of the multispecific CD8 antibodies provided herein, the second target is CD4, the third target is a TCR complex, and the fourth target is a T cell costimulatory molecule. In some embodiments of the multispecific CD8 antibodies provided herein, the second target is CD4, the third target is CD3, and the fourth target is a T cell costimulatory molecule. In some embodiments of the multispecific CD8 antibodies provided herein, the second target is CD4, the third target is CD3ε, and the fourth target is a T cell costimulatory molecule. In some embodiments of the multispecific CD8 antibodies provided herein, the second target is CD4, the third target is CD3γ, and the fourth target is a T cell costimulatory molecule. In some embodiments of the multispecific CD8 antibodies provided herein, the second target is CD4, the third target is CD3δ, and the fourth target is a T cell costimulatory molecule. In some embodiments of the multispecific CD8 antibodies provided herein, the second target is CD4, the third target is CD3ζ, and the fourth target is a T cell costimulatory molecule. In some embodiments of the multispecific CD8 antibodies provided herein, the second target is CD4, the third target is a TCRα chain, and the fourth target is a T cell costimulatory molecule. In some embodiments of the multispecific CD8 antibodies provided herein, the second target is CD4, the third target is a TCRβ chain, and the fourth target is a T cell costimulatory molecule. In some embodiments of the multispecific CD8 antibodies provided herein, the second target is CD4, the third target is a TCRγ chain, and the fourth target is a T cell costimulatory molecule. In certain embodiments, the T cell costimulatory molecule is CD28. In certain embodiments, the T cell costimulatory molecule is CTLA4. In certain embodiments, the T cell costimulatory molecule is ICOS. In certain embodiments, the T cell costimulatory molecule is 4-1BB. In certain embodiments, the T cell costimulatory molecule is GITR. In certain embodiments, the T cell costimulatory molecule is CD27. In certain embodiments, the T cell costimulatory molecule is OX40. In certain embodiments, the T cell costimulatory molecule is CD40L. In certain embodiments, the T cell costimulatory molecule is HVEM. In certain embodiments, the T cell costimulatory molecule is Galectin-9. In certain embodiments, the T cell costimulatory molecule is TIM-1. In certain embodiments, the T cell costimulatory molecule is LFA1. In certain embodiments, the T cell costimulatory molecule is CD2. In certain embodiments, the T cell costimulatory molecule is PD1.

In some embodiments of the multispecific CD8 antibodies provided herein, the second target is a TCR complex, and the third target is a T cell costimulatory molecule. In some embodiments of the multispecific CD8 antibodies provided herein, the second target is CD3, and the third target is a T cell costimulatory molecule. In some embodiments of the multispecific CD8 antibodies provided herein, the second target is CD3ε, and the third target is a T cell costimulatory molecule. In some embodiments of the multispecific CD8 antibodies provided herein, the second target is CD3γ, and the third target is a T cell costimulatory molecule. In some embodiments of the multispecific CD8 antibodies provided herein, the second target is CD3δ, and the third target is a T cell costimulatory molecule. In some embodiments of the multispecific CD8 antibodies provided herein, the second target is CD3ζ, and the third target is a T cell costimulatory molecule. In some embodiments of the multispecific CD8 antibodies provided herein, the second target is a TCRα chain, and the third target is a T cell costimulatory molecule. In some embodiments of the multispecific CD8 antibodies provided herein, the second target is a TCRβ chain, and the third target is a T cell costimulatory molecule. In some embodiments of the multispecific CD8 antibodies provided herein, the second target is a TCRγ chain, and the third target is a T cell costimulatory molecule. In certain embodiments, the T cell costimulatory molecule is CD28. In certain embodiments, the T cell costimulatory molecule is CTLA4. In certain embodiments, the T cell costimulatory molecule is ICOS. In certain embodiments, the T cell costimulatory molecule is 4-1BB. In certain embodiments, the T cell costimulatory molecule is GITR. In certain embodiments, the T cell costimulatory molecule is CD27. In certain embodiments, the T cell costimulatory molecule is OX40. In certain embodiments, the T cell costimulatory molecule is CD40L. In certain embodiments, the T cell costimulatory molecule is HVEM. In certain embodiments, the T cell costimulatory molecule is Galectin-9. In certain embodiments, the T cell costimulatory molecule is TIM-1. In certain embodiments, the T cell costimulatory molecule is LFA1. In certain embodiments, the T cell costimulatory molecule is CD2. In certain embodiments, the T cell costimulatory molecule is PD1.

In a specific embodiment, the target is from a mammal. In a specific embodiment, the target is from a rat. In a specific embodiment, the target is from a mouse. In a specific embodiment, the target is from a primate. In a specific embodiment, the target is from a human.

In specific embodiments, provided is a multispecific antibody comprising a CD8 antibody provided herein in a knob-in-hole format. In specific embodiments, provided is a bispecific antibody comprising a CD8 antibody provided herein in a knob-in-hole format. In specific embodiments, provided is a trispecific antibody comprising a CD8 antibody provided herein in a knob-in-hole format. In specific embodiments, provided is a quadraspecific antibody comprising a CD8 antibody provided herein in a knob-in-hole format. Other specificities can be added to an antibody in knob-in-hole format using methods well known in the art (e.g., adding an scFv to the N-terminus or C-terminus). In addition, other formats and methods of making multispecific antibodies are also known in the art and contemplated. In some embodiments, a CD8 antibody provided herein is comprised in a bispecific antibody. In some embodiments, a CD8 antibody provided herein is comprised in a trispecific antibody. In some embodiments, a CD8 antibody provided herein is comprised in a quadraspecific antibody. In some embodiments, a CD8 bispecific antibody provided herein is comprised in a multispecific antibody.

In certain embodiments, a multispecific antibody provided herein comprises a first binding domain comprising a CD8 antibody provided herein that binds to a first CD8 epitope, and a second binding domain that binds to a second epitope, wherein the first CD8 epitope and the second epitope are not the same. In certain embodiments, a bispecific antibody provided herein comprises a first binding domain comprising a CD8 antibody provided herein that binds to a first CD8 epitope, and a second binding domain that binds to a second epitope, wherein the first CD8 epitope and the second epitope are not the same. In certain embodiments, a trispecific antibody provided herein comprises a first binding domain comprising a CD8 antibody provided herein that binds to a first CD8 epitope, a second binding domain that binds to a second epitope, and a third binding domain that binds to a third epitope, wherein the first CD8 epitope, the second epitope, and the third epitope are not the same. In certain embodiments, a quadraspecific antibody provided herein comprises a first binding domain comprising a CD8 antibody provided herein that binds to a first CD8 epitope, a second binding domain that binds to a second epitope, a third binding domain that binds to a third epitope, and a fourth binding domain that binds to a fourth epitope, wherein the first CD8 epitope, the second epitope, the third epitope, and the fourth epitope are not the same. In certain embodiments, a multispecific antibody provided herein comprises a first binding domain comprising a CD8 antibody provided herein that binds to a first CD8 antigen, and a second binding domain that binds to a second antigen, wherein the first CD8 antigen and the second antigen are not the same. In certain embodiments, a bispecific antibody provided herein comprises a first binding domain comprising a CD8 antibody provided herein that binds to a first CD8 antigen, and a second binding domain that binds to a second antigen, wherein the first CD8 antigen and the second antigen are not the same. In certain embodiments, a trispecific antibody provided herein comprises a first binding domain comprising a CD8 antibody provided herein that binds to a first CD8 antigen, a second binding domain that binds to a second antigen, and a third binding domain that binds to a third antigen, wherein the first CD8 antigen, the second antigen, and the third antigen are not the same. In certain embodiments, a quadraspecific antibody provided herein comprises a first binding domain comprising a CD8 antibody provided herein that binds to a first CD8 antigen, a second binding domain that binds to a second antigen, a third binding domain that binds to a third antigen, and a fourth binding domain that binds to a fourth antigen, wherein the first CD8 antigen, the second antigen, the third antigen, and the fourth antigen are not the same. In a specific embodiment, a CD8 antibody, or antigen binding fragment thereof, provided herein specifically binds to CD8.

In some embodiments, the multispecific antibody comprises heavy chain variable regions and light chain variable region. In some embodiments, the first binding domain comprises a heavy chain variable region and a light chain variable region. In some embodiments, the second binding domain comprises a heavy chain variable region and a light chain variable region. In some embodiments, the first binding domain comprises a heavy chain variable region and a light chain variable region, and the second binding domain comprises a heavy chain variable region and a light chain variable region. In a some embodiments, the CD8 antibody is not a single domain antibody or nanobody. In some embodiments, the third binding domain comprises a heavy chain variable region and a light chain variable region. In some embodiments, the fourth binding domain comprises a heavy chain variable region and a light chain variable region.

In certain embodiments, the CD8 multispecific antibodies or antigen binding fragments thereof bind to a first epitope located on CD8 and a second epitope of a second target antigen. In some embodiments, provided herein is a multispecific antibody comprising: (a) a first binding domain that binds to a CD8 antigen, and (b) a second binding domain that binds to a second target antigen. In some embodiments, provided herein is a multispecific antibody comprising: (a) a first binding domain that specifically binds to a CD8 antigen, and (b) a second binding domain that specifically binds to a second target antigen. In some embodiments, provided herein is a multispecific antibody comprising: (a) a first binding domain that binds to a first epitope on a CD8 antigen, and (b) a second binding domain that binds to a second epitope on a second target antigen. In some embodiments, provided herein is a multispecific antibody comprising: (a) a first binding domain that specifically binds to a first epitope on a CD8 antigen, and (b) a second binding domain that specifically binds to a second epitope on a second target antigen.

In specific embodiments, the CD8 antigen is on the surface of a T cell. In certain embodiments, the second target antigen is not CD8. The binding of the CD8 multispecific antibody to CD8 present on the surface of the T cell, and the binding of the second target antigen present on the surface of the second target cell can, for example, result in the killing of the second target cell. In other embodiment, the binding of the CD8 multispecific antibody to CD8 present on the surface of the T cell, and the binding of a second target antigen can, for example, result in the activation of the T cell.

In one aspect, provided herein is an antibody that binds to CD4. In some embodiments, provided herein is an antibody that binds to a CD4 antigen. In some embodiments, provided herein is an antibody that binds to a CD4 epitope.

In some embodiments, the antibody comprises a heavy chain variable region and a light chain variable region. In a some embodiments, the CD4 antibody is not a single domain antibody or nanobody. In some embodiments, the CD4 antibody is a humanized antibody. In some embodiments, the CD4 antibody is a fully human antibody.

In certain embodiments, provided herein is a CD4 antibody comprising a VH region, VL region, VH CDR1, VH CDR2, VH CDR3, VL CDR1, VL CDR2, and/or VL CDR3 of any one of the antibodies described herein. In some embodiments, provided herein is a CD4 antibody comprising a VH region of any one of the antibodies described herein. In some embodiments, provided herein is a CD4 antibody comprising a VL region of any one of the antibodies described herein. In some embodiments, provided herein is a CD4 antibody comprising a VH region of any one of the antibodies described herein, and a VL region of any one of the antibodies described herein. In some embodiments, provided herein is a CD4 antibody comprising a VH CDR1, VH CDR2, and VH CDR3 of any one of the antibodies described herein. In some embodiments, provided herein is a CD4 antibody comprising a VL CDR1, VL CDR2, and VL CDR3 of any one of the antibodies described herein. In some embodiments, provided herein is a CD4 antibody comprising a VH CDR1, VH CDR2, and VH CDR3 of any one of the antibodies described herein; and a VL CDR1, VL CDR2, and VL CDR3 of any one of the antibodies described herein. Representative VH and VL amino acid sequences, including VH CDR1, VH CDR2, VH CDR3, VL CDR1, VL CDR2 and VL CDR3 amino acid sequences, of CD4 antibodies provided herein are provided in Tables 11-16.

In certain embodiments, provided herein is a CD4 multispecific antibody comprising a binding domain that binds to CD4 having a VH region, VL region, VH CDR1, VH CDR2, VH CDR3, VL CDR1, VL CDR2, and/or VL CDR3 of any one of the antibodies described herein. In some embodiments, provided herein is a CD4 multispecific antibody comprising a binding domain that binds to CD4 having a VH region of any one of the antibodies described herein. In some embodiments, provided herein is a CD4 multispecific antibody comprising a binding domain that binds to CD4 having a VL region of any one of the antibodies described herein. In some embodiments, provided herein is a CD4 multispecific antibody comprising a binding domain that binds to CD4 having a VH region of any one of the antibodies described herein, and a VL region of any one of the antibodies described herein. In some embodiments, provided herein is a CD4 multispecific antibody comprising a binding domain that binds to CD4 having a VH CDR1, VH CDR2, and VH CDR3 of any one of the antibodies described. In some embodiments, provided herein is a CD4 multispecific antibody comprising a binding domain that binds to CD4 having a VL CDR1, VL CDR2, and VL CDR3 of any one of the antibodies described herein. In some embodiments, provided herein is a CD4 multispecific antibody comprising a binding domain that binds to CD4 having a VH CDR1, VH CDR2, and VH CDR3 of any one of the antibodies described herein; and a VL CDR1, VL CDR2, and VL CDR3 of any one of the antibodies described herein. In certain embodiments, the CD4 antibody is a bispecific antibody. In certain embodiments, the CD4 antibody is a trispecific antibody. In certain embodiments, the CD4 antibody is a quadraspecific antibody.

In some embodiments, the antibody specifically binds CD4. In other embodiments, the CD4 is present on the surface of a T cell.

In some embodiments, the antibody is a humanized antibody. In certain embodiments, the antibody is an IgG antibody. In other embodiments, the IgG antibody is an IgG1, IgG2, IgG3, or IgG4 antibody. In some embodiments, the antibody is a bispecific antibody. In some embodiments, the antibody is a trispecific antibody. In some embodiments, the antibody is a quadraspecific antibody. In certain embodiments, the antibody is multivalent. In other embodiments, the antibody is capable of binding at least three antigens. In some embodiments, the antibody is capable of binding at least four antigens. In some embodiments, the antibody is capable of binding at least five antigens.

In certain embodiments, provided is a CD4 antibody that is an intact antibody. In other embodiments, provided is a CD4 antibody is an antigen binding fragment of the CD4 antibody. In some embodiments, the antigen binding fragment of the CD4 antibody is a functional fragment.

In some embodiments, the antigen binding fragment is a diabody. In some embodiments, the antigen binding fragment is a Fab. In some embodiments, the antigen binding fragment is a Fab'. In some embodiments, the antigen binding fragment is a F(ab')2. In some embodiments, the antigen binding fragment is a Fv fragment. In some embodiments, the antigen binding fragment is a disulfide stabilized Fv fragment (dsFv). In some embodiments, the antigen binding fragment is a (dsFv)$_2$. In some embodiments, the antigen binding fragment is a bispecific dsFv (dsFv-dsFv'). In some embodiments, the antigen binding fragment is a disulfide stabilized diabody (ds diabody). In some embodiments, the antigen binding fragment is a single-chain antibody molecule (scFv). In some embodiments, the antigen binding fragment is a single domain antibody (sdAb). In some embodiments, the antigen binding fragment is an scFv dimer (bivalent diabody). In some embodiments, the antigen binding fragment is a multispecific antibody formed from a portion of an antibody comprising one or more CDRs. In some embodiments, the antigen binding fragment is a camelized single domain antibody. In some embodiments, the antigen binding fragment is a nanobody. In some embodiments, the antigen binding fragment is a domain antibody. In some embodiments, the antigen binding fragment is a bivalent domain antibody. In some embodiments, the antigen binding fragment is an antibody fragment that binds to an antigen but does not comprise a complete antibody structure.

In specific embodiments, the CD4 antibody comprises a VH region and a VL region. In some embodiments, the CD4 antibody is a single chain antibody. In some embodiments, the CD4 antibody is a single domain antibody. In some embodiments, the CD4 antibody is a nanobody. In certain embodiments, the CD4 antibody is a VHH antibody. In certain embodiments, the CD4 antibody is a llama antibody. In some embodiments, the CD4 antibody is not a single chain antibody. In some embodiments, the CD4 antibody is not a single domain antibody. In some embodiments, the CD4 antibody is not a nanobody. In certain embodiments, the CD4 antibody is not a VHH antibody. In certain embodiments, the CD4 antibody is not a llama antibody. In some embodiments, the CD4 antibody is a multispecific antibody In other embodiments, the CD4 antibody is a bispecific antibody. In other embodiments, the CD4 antibody is a trispecific antibody. In other embodiments, the CD4 antibody is a quadraspecific antibody. In certain embodiments, the multispecific antibody comprises an antigen binding fragment of a CD4 antibody provided herein. In other embodiments, the bispecific antibody comprises an antigen binding fragment of a CD4 antibody provided herein. In other embodiments, the trispecific antibody comprises an antigen binding fragment of a CD4 antibody provided herein. In other embodiments, the quadraspecific antibody comprises an antigen binding fragment of a CD4 antibody provided herein. In In certain embodiments, the CD4 antibody activates T cells. In other embodiments, the CD4 antibody is an antagonistic antibody. In certain embodiments, the CD4 antibody inactivates T cells. In some embodiments, the CD4 antibody blocks activation of T cells. In some embodiments, the CD4 antibody modulates the activity of T cells. In some embodiments, the CD4 antibody neither activates or inactivates the activity of T cells. In specific embodiments, the T cells are human T cells.

In some embodiments, the VH CDR1, VH CDR2, VH CDR3, VL CDR1, VL CDR2, and VL CDR3 sequences are according to the Kabat numbering system. In some embodiments, the VH CDR1, VH CDR2, VH CDR3, VL CDR1, VL CDR2, and VL CDR3 sequences are according to the Chothia numbering system. In some embodiments, the VH CDR1, VH CDR2, VH CDR3, VL CDR1, VL CDR2, and VL CDR3 sequences are according to the Exemplary numbering system. In some embodiments, the VH CDR1, VH CDR2, VH CDR3, VL CDR1, VL CDR2, and VL CDR3 sequences are according to the Contact numbering system. In some embodiments, the VH CDR1, VH CDR2, VH CDR3, VL CDR1, VL CDR2, and VL CDR3 sequences are according to the IMGT numbering system. In some embodiments, the VH CDR1, VH CDR2, VH CDR3, VL CDR1, VL CDR2, and VL CDR3 sequences are according to the AbM numbering system. Exemplary sets of 6 CDRs (VH CDR1-3 and VL CDR1-3) of certain antibody embodiments are provided herein. Other sets of CDRs are contemplated and within the scope of the antibody embodiments provided herein.

In one aspect, provided herein is an antibody that binds CD4. In one embodiment, provided is an antibody having a VH CDR1, VH CDR2 and a VH CDR3 of a CD4 antibody provided herein. In one embodiment, provided is an antibody having a VL CDR1, VL CDR2 and a VL CDR3 of a CD4 antibody provided herein. In one embodiment, provided is an antibody having a VH CDR1, VH CDR2, VH CDR3, VL CDR1, VL CDR2 and VL CDR3 of a CD4 antibody provided herein. In one embodiment, provided is an antibody having a VH of a CD4 antibody provided herein. In one embodiment, provided is an antibody having a VL of a CD4 antibody provided herein. In one embodiment, provided is an antibody having a VH and a VL of a CD4 antibody provided herein. In one embodiment, provided is an antibody having a heavy chain of a CD4 antibody provided herein. In one embodiment, provided is an antibody having a light chain of a CD4 antibody provided herein. In one embodiment, provided is an antibody having a heavy chain and a light chain of a CD4 antibody provided herein.

In another aspect, provided herein is an antibody that binds CD4. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2207. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2208. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2207; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2208. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2241. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2242. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2241; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2242. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2275. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2276. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2275; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2276. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2309. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2310. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2309; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2310. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2343. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2344. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2343; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2344. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2377. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2378. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2377; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2378. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2411. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2412. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2411; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2412. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2445. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2446. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2445; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2446. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2479. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2480. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2479; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2480. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2513. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2514. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2513; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2514. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2547. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2548. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2547; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2548. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2581. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2582. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2581; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2582. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2615. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2616. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2615; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2616. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2649. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2650. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2649; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2650. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2683. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2684. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2683; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2684. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2717. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2718. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2717; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2718. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2751. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2752. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2751; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2752. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2785. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2786. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2785; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2786. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2819. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2820. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2819; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2820. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2853. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2854. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2853; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2854. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2887. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2888. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2887; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2888. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2921. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2922. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2921; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2922. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2955. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2956. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2955; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2956. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2989. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2990. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2989; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2990. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3023. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3024. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3023; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3024. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3057. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3058. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3057; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3058. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3091. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3092. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3091; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3092. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3125. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3126. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3125; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3126. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3159. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3160. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3159; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3160. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3193. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3194. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3193; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3194. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3227. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3228. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3227; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3228. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3261. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3262. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3261; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3262. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3295. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3296. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3295; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3296. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3329. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3330. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3329; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3330. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3363. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3364. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3363; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3364. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3397. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3398. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3397; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3398. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3431. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3432. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3431; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3432. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3465. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3466. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3465; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3466. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3499. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3500. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3499; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3500. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3533. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3534. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3533; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3534. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3567. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3568. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3567; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3568. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3601. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3602. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3601; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3602. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3635. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3636. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3635; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3636. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3669. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3670. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3669; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3670. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3703. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3704. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3703; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3704. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3737. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3738. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3737; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3738. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3771. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3772. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3771; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3772. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3805. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3806. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3805; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3806. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3839. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3840. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3839; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3840. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3873. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3874. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3873; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3874. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3907. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3908. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3907; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3908. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3941. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3942. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3941; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3942. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3975. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3976. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3975; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3976. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4009. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4010. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4009; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4010. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4043. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4044. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4043; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4044. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4077. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4078. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4077; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4078. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4111. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4112. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4111; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4112. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4145.

In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4146. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4145; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4146. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4179. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4180. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4179; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4180. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4213. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4214. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4213; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4214. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4247. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4248. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4247; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4248. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4281. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4282. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4281; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4282. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4315. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4316. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4315; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4316. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4349. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4350. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4349; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4350. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4383. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4384. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4383; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4384. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4417. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4418. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4417; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4418. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4451. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4452. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4451; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4452. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4485. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4486. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4485; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4486. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4519. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4520. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4519; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4520. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4553. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4554. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4553; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4554. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4587. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4588. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4587; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4588. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4621. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4622. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4621; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4622. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4655. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4656. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4655; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4656. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4689. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4690. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4689; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4690. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4723. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4724. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4723; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4724. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4757. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4758. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4757; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4758. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4791. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4792. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4791; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4792. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4825. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4826. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4825; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4826. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4859. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4860. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4859; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4860. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4893. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4894. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4893; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4894. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4927. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4928. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4927; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4928. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4961. In one embodiment, the CD4 antibody comprises: a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4962. In one embodiment, the CD4 antibody comprises: a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4961; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4962. In some embodiments, the CD4 antibody is a multispecific antibody. In some embodiments, the CD4 antibody is a bispecific antibody. In some embodiments, the CD4 antibody is a trispecific antibody. In some embodiments, the CD4 antibody is a quadraspecific antibody. In certain embodiments, the CD4 antibody is a multispecific antibody, wherein the second target is CD8. In certain embodiments, the CD8×CD4 multispecific antibody comprises a CD8 antibody provided herein and a CD4 antibody provided here.

In one aspect, provided herein is an antibody that binds CD4, comprising: (i) a VH comprising a VH CDR1, a VH CDR2, and a VH CDR3 having an amino acid sequence of SEQ ID NOs:2177, 2178, and 2179, respectively, and (ii) a VL comprising a VL CDR1, VL CDR2, and VL CDR3 having an amino acid sequence of SEQ ID NOs:2180, 2181, and 2182, respectively. In one aspect, provided herein is an antibody that binds CD4, comprising: (i) a VH comprising a VH CDR1, a VH CDR2, and a VH CDR3 having an amino acid sequence of SEQ ID NOs:2183, 2184, and 2185, respectively, and (ii) a VL comprising a VL CDR1, VL CDR2, and VL CDR3 having an amino acid sequence of SEQ ID NOs:2186, 2187, and 2188, respectively. In one aspect, provided herein is an antibody that binds CD4, comprising: (i) a VH comprising a VH CDR1, a VH CDR2, and a VH CDR3 having an amino acid sequence of SEQ ID NOs:2189, 2190, and 2191, respectively, and (ii) a VL comprising a VL CDR1, VL CDR2, and VL CDR3 having an amino acid sequence of SEQ ID NOs:2192, 2193, and 2194, respectively. In one aspect, provided herein is an antibody that binds CD4, comprising: (i) a VH comprising a VH CDR1, a VH CDR2, and a VH CDR3 having an amino acid sequence of SEQ ID NOs:2195, 2196, and 2197, respectively, and (ii) a VL comprising a VL CDR1, VL CDR2, and VL CDR3 having an amino acid sequence of SEQ ID NOs:2198, 2199, and 2200, respectively. In one aspect, provided herein is an antibody that binds CD4, comprising: (i) a VH comprising a VH CDR1, a VH CDR2, and a VH CDR3 having an amino acid sequence of SEQ ID NOs:2201, 2202, and 2203, respectively, and (ii) a VL comprising a VL CDR1, VL CDR2, and VL CDR3 having an amino acid sequence of SEQ ID NOs:2204, 2205, and 2206, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:2207; and (ii) a VL comprising a VL CDR1, a VL CDR2, and a VL CDR3 having an amino acid sequence of a VL CDR1, a VL CDR2, and a VL CDR3, respectively, of SEQ ID NO:2208. In one aspect, provided herein is an antibody that binds CD4, comprising a VH having an amino acid sequence of SEQ ID NO:2207. In one aspect, provided herein is an antibody that binds CD4, comprising a VL having an amino acid sequence of SEQ ID NO:2208. In one aspect, provided herein is an antibody that binds CD4, comprising a VH having an amino acid sequence of SEQ ID NO:2207, and a VL having an amino acid sequence of SEQ ID NO:2208. In one aspect, provided herein is an antibody that binds CD4, comprising a VH having an amino acid sequence having at least 95% identity to an amino acid sequence of SEQ ID NO:2207. In one aspect, provided herein is an antibody that binds CD4, comprising a VL having an amino acid sequence having at least 95% identity to an amino acid sequence of SEQ ID NO:2208. In one aspect, provided herein is an antibody that binds CD4, comprising a VH having an amino acid sequence having at least 95% identity to an amino acid sequence of SEQ ID NO:2207, and a VL having an amino acid sequence having at least 95% identity to an amino acid sequence of SEQ ID NO:2208.

In one aspect, provided herein is an antibody that binds CD4, comprising: (i) a VH comprising a VH CDR1, a VH CDR2, and a VH CDR3 having an amino acid sequence of SEQ ID NOs:2211, 2212, and 2213, respectively, and (ii) a VL comprising a VL CDR1, VL CDR2, and VL CDR3 having an amino acid sequence of SEQ ID NOs:2214, 2215, and 2216, respectively. In one aspect, provided herein is an antibody that binds CD4, comprising: (i) a VH comprising a VH CDR1, a VH CDR2, and a VH CDR3 having an amino acid sequence of SEQ ID NOs:2217, 2218, and 2219, respectively, and (ii) a VL comprising a VL CDR1, VL CDR2, and VL CDR3 having an amino acid sequence of SEQ ID NOs:2220, 2221, and 2222, respectively. In one aspect, provided herein is an antibody that binds CD4, comprising: (i) a VH comprising a VH CDR1, a VH CDR2, and a VH CDR3 having an amino acid sequence of SEQ ID NOs:2223, 2224, and 2225, respectively, and (ii) a VL comprising a VL CDR1, VL CDR2, and VL CDR3 having an amino acid sequence of SEQ ID NOs:2226, 2227, and 2228, respectively. In one aspect, provided herein is an antibody that binds CD4, comprising: (i) a VH comprising a VH CDR1, a VH CDR2, and a VH CDR3 having an amino acid sequence of SEQ ID NOs:2229, 2230, and 2231, respectively, and (ii) a VL comprising a VL CDR1, VL CDR2, and VL CDR3 having an amino acid sequence of SEQ ID NOs:2232, 2233, and 2234, respectively. In one aspect, provided herein is an antibody that binds CD4, comprising: (i) a VH comprising a VH CDR1, a VH CDR2, and a VH CDR3 having an amino acid sequence of SEQ ID NOs:2235, 2236, and 2237, respectively, and (ii) a VL comprising a VL CDR1, VL CDR2, and VL CDR3 having an amino acid sequence of SEQ ID NOs:2238, 2239, and 2240, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:2241; and (ii) a VL comprising a VL CDR1, a VL CDR2, and a VL CDR3 having an amino acid sequence of a VL CDR1, a VL CDR2, and a VL CDR3, respectively, of SEQ ID NO:2242. In one aspect, provided herein is an antibody that binds CD4, comprising a VH having an amino acid sequence of SEQ ID NO:2241. In one aspect, provided herein is an antibody that binds CD4, comprising a VL having an amino acid sequence of SEQ ID NO:2242. In one aspect, provided herein is an antibody that binds CD4, comprising a VH having an amino acid sequence of SEQ ID NO:2241, and a VL having an amino acid sequence of SEQ ID NO:2242. In one aspect, provided herein is an antibody that binds CD4, comprising a VH having an amino acid sequence having at least 95% identity to an amino acid sequence of SEQ ID NO:2241. In one aspect, provided herein is an antibody that binds CD4, comprising a VL having an amino acid sequence having at least 95% identity to an amino acid sequence of SEQ ID NO:2242. In one aspect, provided herein is an antibody that binds CD4, comprising a VH having an amino acid sequence having at least 95% identity to an amino acid sequence of SEQ ID NO:2241, and a VL having an amino acid sequence having at least 95% identity to an amino acid sequence of SEQ ID NO:2242.

In one aspect, provided herein is an antibody that binds CD4, comprising: (i) a VH comprising a VH CDR1, a VH CDR2, and a VH CDR3 having an amino acid sequence of SEQ ID NOs:2245, 2246, and 2247, respectively, and (ii) a VL comprising a VL CDR1, VL CDR2, and VL CDR3 having an amino acid sequence of SEQ ID NOs:2248, 2249, and 2250, respectively. In one aspect, provided herein is an antibody that binds CD4, comprising: (i) a VH comprising a VH CDR1, a VH CDR2, and a VH CDR3 having an amino acid sequence of SEQ ID NOs:2251, 2252, and 2253, respectively, and (ii) a VL comprising a VL CDR1, VL CDR2, and VL CDR3 having an amino acid sequence of SEQ ID NOs:2254, 2255, and 2256, respectively. In one aspect, provided herein is an antibody that binds CD4, comprising: (i) a VH comprising a VH CDR1, a VH CDR2, and a VH CDR3 having an amino acid sequence of SEQ ID NOs:2257, 2258, and 2259, respectively, and (ii) a VL comprising a VL CDR1, VL CDR2, and VL CDR3 having an amino acid sequence of SEQ ID NOs:2260, 2261, and 2262, respectively. In one aspect, provided herein is an antibody that binds CD4, comprising: (i) a VH comprising a VH CDR1, a VH CDR2, and a VH CDR3 having an amino acid sequence of SEQ ID NOs:2263, 2264, and 2265, respectively, and (ii) a VL comprising a VL CDR1, VL CDR2, and VL CDR3 having an amino acid sequence of SEQ ID NOs:2266, 2267, and 2268, respectively. In one aspect, provided herein is an antibody that binds CD4, comprising: (i) a VH comprising a VH CDR1, a VH CDR2, and a VH CDR3 having an amino acid sequence of SEQ ID NOs:2269, 2270, and 2271, respectively, and (ii) a VL comprising a VL CDR1, VL CDR2, and VL CDR3 having an amino acid sequence of SEQ ID NOs:2272, 2273, and 2274, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:2275; and (ii) a VL comprising a VL CDR1, a VL CDR2, and a VL CDR3 having an amino acid sequence of a VL CDR1, a VL CDR2, and a VL CDR3, respectively, of SEQ ID NO:2276. In one aspect, provided herein is an antibody that binds CD4, comprising a VH having an amino acid sequence of SEQ ID NO:2275. In one aspect, provided herein is an antibody that binds CD4, comprising a VL having an amino acid sequence of SEQ ID NO:2276. In one aspect, provided herein is an antibody that binds CD4, comprising a VH having an amino acid sequence having at least 95% identity to an amino acid sequence of SEQ ID NO:2275. In one aspect, provided herein is an antibody that binds CD4, comprising a VL having an amino acid sequence having at least 95% identity to an amino acid sequence of SEQ ID NO:2276. In one aspect, provided herein is an antibody that binds CD4, comprising a VH having an amino acid sequence having at least 95% identity to an amino acid sequence of SEQ ID NO:2275, and a VL having an amino acid sequence having at least 95% identity to an amino acid sequence of SEQ ID NO:2276.

In one aspect, provided herein is an antibody that binds CD4, comprising: (i) a VH comprising a VH CDR1, a VH CDR2, and a VH CDR3 having an amino acid sequence of SEQ ID NOs:2279, 2280, and 2281, respectively, and (ii) a VL comprising a VL CDR1, VL CDR2, and VL CDR3 having an amino acid sequence of SEQ ID NOs:2282, 2283, and 2284, respectively. In one aspect, provided herein is an antibody that binds CD4, comprising: (i) a VH comprising a VH CDR1, a VH CDR2, and a VH CDR3 having an amino acid sequence of SEQ ID NOs:2285, 2286, and 2287, respectively, and (ii) a VL comprising a VL CDR1, VL CDR2, and VL CDR3 having an amino acid sequence of SEQ ID NOs:2288, 2289, and 2290, respectively. In one aspect, provided herein is an antibody that binds CD4, comprising: (i) a VH comprising a VH CDR1, a VH CDR2, and a VH CDR3 having an amino acid sequence of SEQ ID NOs:2291, 2292, and 2293, respectively, and (ii) a VL comprising a VL CDR1, VL CDR2, and VL CDR3 having an amino acid sequence of SEQ ID NOs:2294, 2295, and 2296, respectively. In one aspect, provided herein is an antibody that binds CD4, comprising: (i) a VH comprising a VH CDR1, a VH CDR2, and a VH CDR3 having an amino acid sequence of SEQ ID NOs:2297, 2298, and 2299, respectively, and (ii) a VL comprising a VL CDR1, VL CDR2, and VL CDR3 having an amino acid sequence of SEQ ID NOs:2300, 2301, and 2302, respectively. In one aspect, provided herein is an antibody that binds CD4, comprising: (i) a VH comprising a VH CDR1, a VH CDR2, and a VH CDR3 having an amino acid sequence of SEQ ID NOs:2303, 2304, and 2305, respectively, and (ii) a VL comprising a VL CDR1, VL CDR2, and VL CDR3 having an amino acid sequence of SEQ ID NOs:2306, 2307, and 2308, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:2309; and (ii) a VL comprising a VL CDR1, a VL CDR2, and a VL CDR3 having an amino acid sequence of a VL CDR1, a VL CDR2, and a VL CDR3, respectively, of SEQ ID NO:2310. In one aspect, provided herein is an antibody that binds CD4, comprising a VH having an amino acid sequence of SEQ ID NO:2309. In one aspect, provided herein is an antibody that binds CD4, comprising a VL having an amino acid sequence of SEQ ID NO:2310. In one aspect, provided herein is an antibody that binds CD4, comprising a VH having an amino acid sequence of SEQ ID NO:2309, and a VL having an amino acid sequence of SEQ ID NO:2310. In one aspect, provided herein is an antibody that binds CD4, comprising a heavy chain having an amino acid sequence of SEQ ID NO:2311. In one aspect, provided herein is an antibody that binds CD4, comprising a light chain having an amino acid sequence of SEQ ID NO:2312. In one aspect, provided herein is an antibody that binds CD4, comprising a heavy chain having an amino acid sequence of SEQ ID NO:2311, and a light chain having an amino acid sequence of SEQ ID NO:2312. In one aspect, provided herein is an antibody that binds CD4, comprising a VH having an amino acid sequence having at least 95% identity to an amino acid sequence of SEQ ID NO:2309. In one aspect, provided herein is an antibody that binds CD4, comprising a VL having an amino acid sequence having at least 95% identity to an amino acid sequence of SEQ ID NO:2310. In one aspect, provided herein is an antibody that binds CD4, comprising a VH having an amino acid sequence having at least 95% identity to an amino acid sequence of SEQ ID NO:2309, and a VL having an amino acid sequence having at least 95% identity to an amino acid sequence of SEQ ID NO:2310. In one aspect, provided herein is an antibody that binds CD4, comprising a heavy chain having an amino acid sequence having at least 95% identity to an amino acid sequence of SEQ ID NO:2311. In one aspect, provided herein is an antibody that binds CD4, comprising a light chain having an amino acid sequence having at least 95% identity to an amino acid sequence of SEQ ID NO:2312. In one aspect, provided herein is an antibody that binds CD4, comprising a heavy chain having an amino acid sequence having at least 95% identity to an amino acid sequence of SEQ ID NO:2311, and a light chain having an amino acid sequence having at least 95% identity to an amino acid sequence of SEQ ID NO:2312.

In one aspect, provided herein is an antibody that binds CD4, comprising: (i) a VH comprising a VH CDR1, a VH CDR2, and a VH CDR3 having an amino acid sequence of SEQ ID NOs:2313, 2314, and 2315, respectively, and (ii) a VL comprising a VL CDR1, VL CDR2, and VL CDR3 having an amino acid sequence of SEQ ID NOs:2316, 2317, and 2318, respectively. In one aspect, provided herein is an antibody that binds CD4, comprising: (i) a VH comprising a VH CDR1, a VH CDR2, and a VH CDR3 having an amino acid sequence of SEQ ID NOs:2319, 2320, and 2321, respectively, and (ii) a VL comprising a VL CDR1, VL CDR2, and VL CDR3 having an amino acid sequence of SEQ ID NOs:2322, 2323, and 2324, respectively. In one aspect, provided herein is an antibody that binds CD4, comprising: (i) a VH comprising a VH CDR1, a VH CDR2, and a VH CDR3 having an amino acid sequence of SEQ ID NOs:2325, 2326, and 2327, respectively, and (ii) a VL comprising a VL CDR1, VL CDR2, and VL CDR3 having an amino acid sequence of SEQ ID NOs:2328, 2329, and 2330, respectively. In one aspect, provided herein is an antibody that binds CD4, comprising: (i) a VH comprising a VH CDR1, a VH CDR2, and a VH CDR3 having an amino acid sequence of SEQ ID NOs:2331, 2332, and 2333, respectively, and (ii) a VL comprising a VL CDR1, VL CDR2, and VL CDR3 having an amino acid sequence of SEQ ID NOs:2334, 2335, and 2336, respectively. In one aspect, provided herein is an antibody that binds CD4, comprising: (i) a VH comprising a VH CDR1, a VH CDR2, and a VH CDR3 having an amino acid sequence of SEQ ID NOs:2337, 2338, and 2339, respectively, and (ii) a VL comprising a VL CDR1, VL CDR2, and VL CDR3 having an amino acid sequence of SEQ ID NOs:2340, 2341, and 2342, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:2343; and (ii) a VL comprising a VL CDR1, a VL CDR2, and a VL CDR3 having an amino acid sequence of a VL CDR1, a VL CDR2, and a VL CDR3, respectively, of SEQ ID NO:2344. In one aspect, provided herein is an antibody that binds CD4, comprising a VH having an amino acid sequence of SEQ ID NO:2343. In one aspect, provided herein is an antibody that binds CD4, comprising a VL having an amino acid sequence of SEQ ID NO:2344. In one aspect, provided herein is an antibody that binds CD4, comprising a VH having an amino acid sequence of SEQ ID NO:2343, and a VL having an amino acid sequence of SEQ ID NO:2344. In one aspect, provided herein is an antibody that binds CD4, comprising a VH having an amino acid sequence having at least 95% identity to an amino acid sequence of SEQ ID NO:2343. In one aspect, provided herein is an antibody that binds CD4, comprising a VL having an amino acid sequence having at least 95% identity to an amino acid sequence of SEQ ID NO:2344. In one aspect, provided herein is an antibody that binds CD4, comprising a VH having an amino acid sequence having at least 95% identity to an amino acid sequence of SEQ ID NO:2343, and a VL having an amino acid sequence having at least 95% identity to an amino acid sequence of SEQ ID NO:2344.

In one aspect, provided herein is an antibody that binds CD4, comprising: (i) a VH comprising a VH CDR1, a VH CDR2, and a VH CDR3 having an amino acid sequence of SEQ ID NOs:2347, 2348, and 2349, respectively, and (ii) a VL comprising a VL CDR1, VL CDR2, and VL CDR3 having an amino acid sequence of SEQ ID NOs:2350, 2351, and 2352, respectively. In one aspect, provided herein is an antibody that binds CD4, comprising: (i) a VH comprising a VH CDR1, a VH CDR2, and a VH CDR3 having an amino acid sequence of SEQ ID NOs:2353, 2354, and 2355, respectively, and (ii) a VL comprising a VL CDR1, VL CDR2, and VL CDR3 having an amino acid sequence of SEQ ID NOs:2356, 2357, and 2358, respectively. In one aspect, provided herein is an antibody that binds CD4, comprising: (i) a VH comprising a VH CDR1, a VH CDR2, and a VH CDR3 having an amino acid sequence of SEQ ID NOs:2359, 2360, and 2361, respectively, and (ii) a VL comprising a VL CDR1, VL CDR2, and VL CDR3 having an amino acid sequence of SEQ ID NOs:2362, 2363, and 2364, respectively. In one aspect, provided herein is an antibody that binds CD4, comprising: (i) a VH comprising a VH CDR1, a VH CDR2, and a VH CDR3 having an amino acid sequence of SEQ ID NOs:2365, 2366, and 2367, respectively, and (ii) a VL comprising a VL CDR1, VL CDR2, and VL CDR3 having an amino acid sequence of SEQ ID NOs:2368, 2369, and 2370, respectively. In one aspect, provided herein is an antibody that binds CD4, comprising: (i) a VH comprising a VH CDR1, a VH CDR2, and a VH CDR3 having an amino acid sequence of SEQ ID NOs:2371, 2372, and 2373, respectively, and (ii) a VL comprising a VL CDR1, VL CDR2, and VL CDR3 having an amino acid sequence of SEQ ID NOs:2374, 2375, and 2376, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:2377; and (ii) a VL comprising a VL CDR1, a VL CDR2, and a VL CDR3 having an amino acid sequence of a VL CDR1, a VL CDR2, and a VL CDR3, respectively, of SEQ ID NO:2378. In one aspect, provided herein is an antibody that binds CD4, comprising a VH having an amino acid sequence of SEQ ID NO:2377. In one aspect, provided herein is an antibody that binds CD4, comprising a VL having an amino acid sequence of SEQ ID NO:2378. In one aspect, provided herein is an antibody that binds CD4, comprising a VH having an amino acid sequence of SEQ ID NO:2377, and a VL having an amino acid sequence of SEQ ID NO:2378. In one aspect, provided herein is an antibody that binds CD4, comprising a VH having an amino acid sequence having at least 95% identity to an amino acid sequence of SEQ ID NO:2377. In one aspect, provided herein is an antibody that binds CD4, comprising a VL having an amino acid sequence having at least 95% identity to an amino acid sequence of SEQ ID NO:2378. In one aspect, provided herein is an antibody that binds CD4, comprising a VH having an amino acid sequence having at least 95% identity to an amino acid sequence of SEQ ID NO:2377, and a VL having an amino acid sequence having at least 95% identity to an amino acid sequence of SEQ ID NO:2378.

In one aspect, provided herein is an antibody that binds CD4, comprising: (i) a VH comprising a VH CDR1, a VH CDR2, and a VH CDR3 having an amino acid sequence of SEQ ID NOs:2381, 2382, and 2383, respectively, and (ii) a VL comprising a VL CDR1, VL CDR2, and VL CDR3 having an amino acid sequence of SEQ ID NOs:2384, 2385, and 2386, respectively. In one aspect, provided herein is an antibody that binds CD4, comprising: (i) a VH comprising a VH CDR1, a VH CDR2, and a VH CDR3 having an amino acid sequence of SEQ ID NOs:2387, 2388, and 2389, respectively, and (ii) a VL comprising a VL CDR1, VL CDR2, and VL CDR3 having an amino acid sequence of SEQ ID NOs:2390, 2391, and 2392, respectively. In one aspect, provided herein is an antibody that binds CD4, comprising: (i) a VH comprising a VH CDR1, a VH CDR2, and a VH CDR3 having an amino acid sequence of SEQ ID NOs:2393, 2394, and 2395, respectively, and (ii) a VL comprising a VL CDR1, VL CDR2, and VL CDR3 having an amino acid sequence of SEQ ID NOs:2396, 2397, and 2398, respectively. In one aspect, provided herein is an antibody that binds CD4, comprising: (i) a VH comprising a VH CDR1, a VH CDR2, and a VH CDR3 having an amino acid sequence of SEQ ID NOs:2399, 2400, and 2401, respectively, and (ii) a VL comprising a VL CDR1, VL CDR2, and VL CDR3 having an amino acid sequence of SEQ ID NOs:2402, 2403, and 2404, respectively. In one aspect, provided herein is an antibody that binds CD4, comprising: (i) a VH comprising a VH CDR1, a VH CDR2, and a VH CDR3 having an amino acid sequence of SEQ ID NOs:2405, 2406, and 2407, respectively, and (ii) a VL comprising a VL CDR1, VL CDR2, and VL CDR3 having an amino acid sequence of SEQ ID NOs:2408, 2409, and 2410, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:2411; and (ii) a VL comprising a VL CDR1, a VL CDR2, and a VL CDR3 having an amino acid sequence of a VL CDR1, a VL CDR2, and a VL CDR3, respectively, of SEQ ID NO:2412. In one aspect, provided herein is an antibody that binds CD4, comprising a VH having an amino acid sequence of SEQ ID NO:2411. In one aspect, provided herein is an antibody that binds CD4, comprising a VL having an amino acid sequence of SEQ ID NO:2412. In one aspect, provided herein is an antibody that binds CD4, comprising a VH having an amino acid sequence of SEQ ID NO:2411, and a VL having an amino acid sequence of SEQ ID NO:2412. In one aspect, provided herein is an antibody that binds CD4, comprising a VH having an amino acid sequence having at least 95% identity to an amino acid sequence of SEQ ID NO:2411. In one aspect, provided herein is an antibody that binds CD4, comprising a VL having an amino acid sequence having at least 95% identity to an amino acid sequence of SEQ ID NO:2412. In one aspect, provided herein is an antibody that binds CD4, comprising a VH having an amino acid sequence having at least 95% identity to an amino acid sequence of SEQ ID NO:2411, and a VL having an amino acid sequence having at least 95% identity to an amino acid sequence of SEQ ID NO:2412.

In one aspect, provided herein is an antibody that binds CD4, comprising: (i) a VH comprising a VH CDR1, a VH CDR2, and a VH CDR3 having an amino acid sequence of SEQ ID NOs:2415, 2416, and 2417, respectively, and (ii) a VL comprising a VL CDR1, VL CDR2, and VL CDR3 having an amino acid sequence of SEQ ID NOs:2418, 2419, and 2420, respectively. In one aspect, provided herein is an antibody that binds CD4, comprising: (i) a VH comprising a VH CDR1, a VH CDR2, and a VH CDR3 having an amino acid sequence of SEQ ID NOs:2421, 2422, and 2423, respectively, and (ii) a VL comprising a VL CDR1, VL CDR2, and VL CDR3 having an amino acid sequence of SEQ ID NOs:2424, 2425, and 2426, respectively. In one aspect, provided herein is an antibody that binds CD4, comprising: (i) a VH comprising a VH CDR1, a VH CDR2, and a VH CDR3 having an amino acid sequence of SEQ ID NOs:2427, 2428, and 2429, respectively, and (ii) a VL comprising a VL CDR1, VL CDR2, and VL CDR3 having an amino acid sequence of SEQ ID NOs:2430, 2431, and 2432, respectively. In one aspect, provided herein is an antibody that binds CD4, comprising: (i) a VH comprising a VH CDR1, a VH CDR2, and a VH CDR3 having an amino acid sequence of SEQ ID NOs:2433, 2434, and 2435, respectively, and (ii) a VL comprising a VL CDR1, VL CDR2, and VL CDR3 having an amino acid sequence of SEQ ID NOs:2436, 2437, and 2438, respectively. In one aspect, provided herein is an antibody that binds CD4, comprising: (i) a VH comprising a VH CDR1, a VH CDR2, and a VH CDR3 having an amino acid sequence of SEQ ID NOs:2439, 2440, and 2441, respectively, and (ii) a VL comprising a VL CDR1, VL CDR2, and VL CDR3 having an amino acid sequence of SEQ ID NOs:2442, 2443, and 2444, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:2445; and (ii) a VL comprising a VL CDR1, a VL CDR2, and a VL CDR3 having an amino acid sequence of a VL CDR1, a VL CDR2, and a VL CDR3, respectively, of SEQ ID NO:2446. In one aspect, provided herein is an antibody that binds CD4, comprising a VH having an amino acid sequence of SEQ ID NO:2445. In one aspect, provided herein is an antibody that binds CD4, comprising a VL having an amino acid sequence of SEQ ID NO:2446. In one aspect, provided herein is an antibody that binds CD4, comprising a VH having an amino acid sequence of SEQ ID NO:2445, and a VL having an amino acid sequence of SEQ ID NO:2446. In one aspect, provided herein is an antibody that binds CD4, comprising a heavy chain having an amino acid sequence of SEQ ID NO:2447. In one aspect, provided herein is an antibody that binds CD4, comprising a light chain having an amino acid sequence of SEQ ID NO:2448. In one aspect, provided herein is an antibody that binds CD4, comprising a heavy chain having an amino acid sequence of SEQ ID NO:2447, and a light chain having an amino acid sequence of SEQ ID NO:2448. In one aspect, provided herein is an antibody that binds CD4, comprising a VH having an amino acid sequence having at least 95% identity to an amino acid sequence of SEQ ID NO:2445. In one aspect, provided herein is an antibody that binds CD4, comprising a VL having an amino acid sequence having at least 95% identity to an amino acid sequence of SEQ ID NO:2446. In one aspect, provided herein is an antibody that binds CD4, comprising a VH having an amino acid sequence having at least 95% identity to an amino acid sequence of SEQ ID NO:2445, and a VL having an amino acid sequence having at least 95% identity to an amino acid sequence of SEQ ID NO:2446. In one aspect, provided herein is an antibody that binds CD4, comprising a heavy chain having an amino acid sequence having at least 95% identity to an amino acid sequence of SEQ ID NO:2447. In one aspect, provided herein is an antibody that binds CD4, comprising a light chain having an amino acid sequence having at least 95% identity to an amino acid sequence of SEQ ID NO:2448. In one aspect, provided herein is an antibody that binds CD4, comprising a heavy chain having an amino acid sequence having at least 95% identity to an amino acid sequence of SEQ ID NO:2447, and a light chain having an amino acid sequence having at least 95% identity to an amino acid sequence of SEQ ID NO:2448.

In one aspect, provided herein is an antibody that binds CD4, comprising: (i) a VH comprising a VH CDR1, a VH CDR2, and a VH CDR3 having an amino acid sequence of SEQ ID NOs:2449, 2450, and 2451, respectively, and (ii) a VL comprising a VL CDR1, VL CDR2, and VL CDR3 having an amino acid sequence of SEQ ID NOs:2452, 2453, and 2454, respectively. In one aspect, provided herein is an antibody that binds CD4, comprising: (i) a VH comprising a VH CDR1, a VH CDR2, and a VH CDR3 having an amino acid sequence of SEQ ID NOs:2455, 2456, and 2457, respectively, and (ii) a VL comprising a VL CDR1, VL CDR2, and VL CDR3 having an amino acid sequence of SEQ ID NOs:2458, 2459, and 2460, respectively. In one aspect, provided herein is an antibody that binds CD4, comprising: (i) a VH comprising a VH CDR1, a VH CDR2, and a VH CDR3 having an amino acid sequence of SEQ ID NOs:2461, 2462, and 2463, respectively, and (ii) a VL comprising a VL CDR1, VL CDR2, and VL CDR3 having an amino acid sequence of SEQ ID NOs:2464, 2465, and 2466, respectively. In one aspect, provided herein is an antibody that binds CD4, comprising: (i) a VH comprising a VH CDR1, a VH CDR2, and a VH CDR3 having an amino acid sequence of SEQ ID NOs:2467, 2468, and 2469, respectively, and (ii) a VL comprising a VL CDR1, VL CDR2, and VL CDR3 having an amino acid sequence of SEQ ID NOs:2470, 2471, and 2472, respectively. In one aspect, provided herein is an antibody that binds CD4, comprising: (i) a VH comprising a VH CDR1, a VH CDR2, and a VH CDR3 having an amino acid sequence of SEQ ID NOs:2473, 2474, and 2475, respectively, and (ii) a VL comprising a VL CDR1, VL CDR2, and VL CDR3 having an amino acid sequence of SEQ ID NOs:2476, 2477, and 2478, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:2479; and (ii) a VL comprising a VL CDR1, a VL CDR2, and a VL CDR3 having an amino acid sequence of a VL CDR1, a VL CDR2, and a VL CDR3, respectively, of SEQ ID NO:2480. In one aspect, provided herein is an antibody that binds CD4, comprising a VH having an amino acid sequence of SEQ ID NO:2479. In one aspect, provided herein is an antibody that binds CD4, comprising a VL having an amino acid sequence of SEQ ID NO:2480. In one aspect, provided herein is an antibody that binds CD4, comprising a VH having an amino acid sequence of SEQ ID NO:2479, and a VL having an amino acid sequence of SEQ ID NO:2480. In one aspect, provided herein is an antibody that binds CD4, comprising a VH having an amino acid sequence having at least 95% identity to an amino acid sequence of SEQ ID NO:2479. In one aspect, provided herein is an antibody that binds CD4, comprising a VL having an amino acid sequence having at least 95% identity to an amino acid sequence of SEQ ID NO:2480. In one aspect, provided herein is an antibody that binds CD4, comprising a VH having an amino acid sequence having at least 95% identity to an amino acid sequence of SEQ ID NO:2479, and a VL having an amino acid sequence having at least 95% identity to an amino acid sequence of SEQ ID NO:2480.

In one aspect, provided herein is an antibody that binds CD4, comprising: (i) a VH comprising a VH CDR1, a VH CDR2, and a VH CDR3 having an amino acid sequence of SEQ ID NOs:2483, 2484, and 2485, respectively, and (ii) a VL comprising a VL CDR1, VL CDR2, and VL CDR3 having an amino acid sequence of SEQ ID NOs:2486, 2487, and 2488, respectively. In one aspect, provided herein is an antibody that binds CD4, comprising: (i) a VH comprising a VH CDR1, a VH CDR2, and a VH CDR3 having an amino acid sequence of SEQ ID NOs:2489, 2490, and 2491, respectively, and (ii) a VL comprising a VL CDR1, VL CDR2, and VL CDR3 having an amino acid sequence of SEQ ID NOs:2492, 2493, and 2494, respectively. In one aspect, provided herein is an antibody that binds CD4, comprising: (i) a VH comprising a VH CDR1, a VH CDR2, and a VH CDR3 having an amino acid sequence of SEQ ID NOs:2495, 2496, and 2497, respectively, and (ii) a VL comprising a VL CDR1, VL CDR2, and VL CDR3 having an amino acid sequence of SEQ ID NOs:2498, 2499, and 2500, respectively. In one aspect, provided herein is an antibody that binds CD4, comprising: (i) a VH comprising a VH CDR1, a VH CDR2, and a VH CDR3 having an amino acid sequence of SEQ ID NOs:2501, 2502, and 2503, respectively, and (ii) a VL comprising a VL CDR1, VL CDR2, and VL CDR3 having an amino acid sequence of SEQ ID NOs:2504, 2505, and 2506, respectively. In one aspect, provided herein is an antibody that binds CD4, comprising: (i) a VH comprising a VH CDR1, a VH CDR2, and a VH CDR3 having an amino acid sequence of SEQ ID NOs:2507, 2508, and 2509, respectively, and (ii) a VL comprising a VL CDR1, VL CDR2, and VL CDR3 having an amino acid sequence of SEQ ID NOs:2510, 2511, and 2512, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:2513; and (ii) a VL comprising a VL CDR1, a VL CDR2, and a VL CDR3 having an amino acid sequence of a VL CDR1, a VL CDR2, and a VL CDR3, respectively, of SEQ ID NO:2514. In one aspect, provided herein is an antibody that binds CD4, comprising a VH having an amino acid sequence of SEQ ID NO:2513. In one aspect, provided herein is an antibody that binds CD4, comprising a VL having an amino acid sequence of SEQ ID NO:2514. In one aspect, provided herein is an antibody that binds CD4, comprising a VH having an amino acid sequence of SEQ ID NO:2513, and a VL having an amino acid sequence of SEQ ID NO:2514. In one aspect, provided herein is an antibody that binds CD4, comprising a heavy chain having an amino acid sequence of SEQ ID NO:2515. In one aspect, provided herein is an antibody that binds CD4, comprising a light chain having an amino acid sequence of SEQ ID NO:2516. In one aspect, provided herein is an antibody that binds CD4, comprising a heavy chain having an amino acid sequence of SEQ ID NO:2515, and a light chain having an amino acid sequence of SEQ ID NO:2516. In one aspect, provided herein is an antibody that binds CD4, comprising a VH having an amino acid sequence having at least 95% identity to an amino acid sequence of SEQ ID NO:2513. In one aspect, provided herein is an antibody that binds CD4, comprising a VL having an amino acid sequence having at least 95% identity to an amino acid sequence of SEQ ID NO:2514. In one aspect, provided herein is an antibody that binds CD4, comprising a VH having an amino acid sequence having at least 95% identity to an amino acid sequence of SEQ ID NO:2513, and a VL having an amino acid sequence having at least 95% identity to an amino acid sequence of SEQ ID NO:2514. In one aspect, provided herein is an antibody that binds CD4, comprising a heavy chain having an amino acid sequence having at least 95% identity to an amino acid sequence of SEQ ID NO:2515. In one aspect, provided herein is an antibody that binds CD4, comprising a light chain having an amino acid sequence having at least 95% identity to an amino acid sequence of SEQ ID NO:2516. In one aspect, provided herein is an antibody that binds CD4, comprising a heavy chain having an amino acid sequence having at least 95% identity to an amino acid sequence of SEQ ID NO:2515, and a light chain having an amino acid sequence having at least 95% identity to an amino acid sequence of SEQ ID NO:2516.

In one aspect, provided herein is an antibody that binds CD4, comprising: (i) a VH comprising a VH CDR1, a VH CDR2, and a VH CDR3 having an amino acid sequence of SEQ ID NOs:2517, 2518, and 2519, respectively, and (ii) a VL comprising a VL CDR1, VL CDR2, and VL CDR3 having an amino acid sequence of SEQ ID NOs:2520, 2521, and 2522, respectively. In one aspect, provided herein is an antibody that binds CD4, comprising: (i) a VH comprising a VH CDR1, a VH CDR2, and a VH CDR3 having an amino acid sequence of SEQ ID NOs:2523, 2524, and 2525, respectively, and (ii) a VL comprising a VL CDR1, VL CDR2, and VL CDR3 having an amino acid sequence of SEQ ID NOs:2526, 2527, and 2528, respectively. In one aspect, provided herein is an antibody that binds CD4, comprising: (i) a VH comprising a VH CDR1, a VH CDR2, and a VH CDR3 having an amino acid sequence of SEQ ID NOs:2529, 2530, and 2531, respectively, and (ii) a VL comprising a VL CDR1, VL CDR2, and VL CDR3 having an amino acid sequence of SEQ ID NOs:2532, 2533, and 2534, respectively. In one aspect, provided herein is an antibody that binds CD4, comprising: (i) a VH comprising a VH CDR1, a VH CDR2, and a VH CDR3 having an amino acid sequence of SEQ ID NOs:2535, 2536, and 2537, respectively, and (ii) a VL comprising a VL CDR1, VL CDR2, and VL CDR3 having an amino acid sequence of SEQ ID NOs:2538, 2539, and 2540, respectively. In one aspect, provided herein is an antibody that binds CD4, comprising: (i) a VH comprising a VH CDR1, a VH CDR2, and a VH CDR3 having an amino acid sequence of SEQ ID NOs:2541, 2542, and 2543, respectively, and (ii) a VL comprising a VL CDR1, VL CDR2, and VL CDR3 having an amino acid sequence of SEQ ID NOs:2544, 2545, and 2546, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:2547; and (ii) a VL comprising a VL CDR1, a VL CDR2, and a VL CDR3 having an amino acid sequence of a VL CDR1, a VL CDR2, and a VL CDR3, respectively, of SEQ ID NO:2548. In one aspect, provided herein is an antibody that binds CD4, comprising a VH having an amino acid sequence of SEQ ID NO:2547. In one aspect, provided herein is an antibody that binds CD4, comprising a VL having an amino acid sequence of SEQ ID NO:2548. In one aspect, provided herein is an antibody that binds CD4, comprising a VH having an amino acid sequence of SEQ ID NO:2547, and a VL having an amino acid sequence of SEQ ID NO:2548. In one aspect, provided herein is an antibody that binds CD4, comprising a VH having an amino acid sequence having at least 95% identity to an amino acid sequence of SEQ ID NO:2547. In one aspect, provided herein is an antibody that binds CD4, comprising a VL having an amino acid sequence having at least 95% identity to an amino acid sequence of SEQ ID NO:2548. In one aspect, provided herein is an antibody that binds CD4, comprising a VH having an amino acid sequence having at least 95% identity to an amino acid sequence of SEQ ID NO:2547, and a VL having an amino acid sequence having at least 95% identity to an amino acid sequence of SEQ ID NO:2548.

In one aspect, provided herein is an antibody that binds CD4, comprising: (i) a VH comprising a VH CDR1, a VH CDR2, and a VH CDR3 having an amino acid sequence of SEQ ID NOs:2551, 2552, and 2553, respectively, and (ii) a VL comprising a VL CDR1, VL CDR2, and VL CDR3 having an amino acid sequence of SEQ ID NOs:2554, 2555, and 2556, respectively. In one aspect, provided herein is an antibody that binds CD4, comprising: (i) a VH comprising a VH CDR1, a VH CDR2, and a VH CDR3 having an amino acid sequence of SEQ ID NOs:2557, 2558, and 2559, respectively, and (ii) a VL comprising a VL CDR1, VL CDR2, and VL CDR3 having an amino acid sequence of SEQ ID NOs:2560, 2561, and 2562, respectively. In one aspect, provided herein is an antibody that binds CD4, comprising: (i) a VH comprising a VH CDR1, a VH CDR2, and a VH CDR3 having an amino acid sequence of SEQ ID NOs:2563, 2564, and 2565, respectively, and (ii) a VL comprising a VL CDR1, VL CDR2, and VL CDR3 having an amino acid sequence of SEQ ID NOs:2566, 2567, and 2568, respectively. In one aspect, provided herein is an antibody that binds CD4, comprising: (i) a VH comprising a VH CDR1, a VH CDR2, and a VH CDR3 having an amino acid sequence of SEQ ID NOs:2569, 2570, and 2571, respectively, and (ii) a VL comprising a VL CDR1, VL CDR2, and VL CDR3 having an amino acid sequence of SEQ ID NOs:2572, 2573, and 2574, respectively. In one aspect, provided herein is an antibody that binds CD4, comprising: (i) a VH comprising a VH CDR1, a VH CDR2, and a VH CDR3 having an amino acid sequence of SEQ ID NOs:2575, 2576, and 2577, respectively, and (ii) a VL comprising a VL CDR1, VL CDR2, and VL CDR3 having an amino acid sequence of SEQ ID NOs:2578, 2579, and 2580, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:2581; and (ii) a VL comprising a VL CDR1, a VL CDR2, and a VL CDR3 having an amino acid sequence of a VL CDR1, a VL CDR2, and a VL CDR3, respectively, of SEQ ID NO:2582. In one aspect, provided herein is an antibody that binds CD4, comprising a VH having an amino acid sequence of SEQ ID NO:2581. In one aspect, provided herein is an antibody that binds CD4, comprising a VL having an amino acid sequence of SEQ ID NO:2582. In one aspect, provided herein is an antibody that binds CD4, comprising a VH having an amino acid sequence of SEQ ID NO:2581, and a VL having an amino acid sequence of SEQ ID NO:2582. In one aspect, provided herein is an antibody that binds CD4, comprising a VH having an amino acid sequence having at least 95% identity to an amino acid sequence of SEQ ID NO:2581. In one aspect, provided herein is an antibody that binds CD4, comprising a VL having an amino acid sequence having at least 95% identity to an amino acid sequence of SEQ ID NO:2582. In one aspect, provided herein is an antibody that binds CD4, comprising a VH having an amino acid sequence having at least 95% identity to an amino acid sequence of SEQ ID NO:2581, and a VL having an amino acid sequence having at least 95% identity to an amino acid sequence of SEQ ID NO:2582.

In one aspect, provided herein is an antibody that binds CD4, comprising: (i) a VH comprising a VH CDR1, a VH CDR2, and a VH CDR3 having an amino acid sequence of SEQ ID NOs:2585, 2586, and 2587, respectively, and (ii) a VL comprising a VL CDR1, VL CDR2, and VL CDR3 having an amino acid sequence of SEQ ID NOs:2588, 2589, and 2590, respectively. In one aspect, provided herein is an antibody that binds CD4, comprising: (i) a VH comprising a VH CDR1, a VH CDR2, and a VH CDR3 having an amino acid sequence of SEQ ID NOs:2591, 2592, and 2593, respectively, and (ii) a VL comprising a VL CDR1, VL CDR2, and VL CDR3 having an amino acid sequence of SEQ ID NOs:2594, 2595, and 2596, respectively. In one aspect, provided herein is an antibody that binds CD4, comprising: (i) a VH comprising a VH CDR1, a VH CDR2, and a VH CDR3 having an amino acid sequence of SEQ ID NOs:2597, 2598, and 2599, respectively, and (ii) a VL comprising a VL CDR1, VL CDR2, and VL CDR3 having an amino acid sequence of SEQ ID NOs:2600, 2601, and 2602, respectively. In one aspect, provided herein is an antibody that binds CD4, comprising: (i) a VH comprising a VH CDR1, a VH CDR2, and a VH CDR3 having an amino acid sequence of SEQ ID NOs:2603, 2604, and 2605, respectively, and (ii) a VL comprising a VL CDR1, VL CDR2, and VL CDR3 having an amino acid sequence of SEQ ID NOs:2606, 2607, and 2608, respectively. In one aspect, provided herein is an antibody that binds CD4, comprising: (i) a VH comprising a VH CDR1, a VH CDR2, and a VH CDR3 having an amino acid sequence of SEQ ID NOs:2609, 2610, and 2611, respectively, and (ii) a VL comprising a VL CDR1, VL CDR2, and VL CDR3 having an amino acid sequence of SEQ ID NOs:2612, 2613, and 2614, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:2615; and (ii) a VL comprising a VL CDR1, a VL CDR2, and a VL CDR3 having an amino acid sequence of a VL CDR1, a VL CDR2, and a VL CDR3, respectively, of SEQ ID NO:2616. In one aspect, provided herein is an antibody that binds CD4, comprising a VH having an amino acid sequence of SEQ ID NO:2615. In one aspect, provided herein is an antibody that binds CD4, comprising a VL having an amino acid sequence of SEQ ID NO:2616. In one aspect, provided herein is an antibody that binds CD4, comprising a VH having an amino acid sequence of SEQ ID NO:2615, and a VL having an amino acid sequence of SEQ ID NO:2616. In one aspect, provided herein is an antibody that binds CD4, comprising a VH having an amino acid sequence having at least 95% identity to an amino acid sequence of SEQ ID NO:2615. In one aspect, provided herein is an antibody that binds CD4, comprising a VL having an amino acid sequence having at least 95% identity to an amino acid sequence of SEQ ID NO:2616. In one aspect, provided herein is an antibody that binds CD4, comprising a VH having an amino acid sequence having at least 95% identity to an amino acid sequence of SEQ ID NO:2615, and a VL having an amino acid sequence having at least 95% identity to an amino acid sequence of SEQ ID NO:2616.

In one aspect, provided herein is an antibody that binds CD4, comprising: (i) a VH comprising a VH CDR1, a VH CDR2, and a VH CDR3 having an amino acid sequence of SEQ ID NOs:2619, 2620, and 2621, respectively, and (ii) a VL comprising a VL CDR1, VL CDR2, and VL CDR3 having an amino acid sequence of SEQ ID NOs:2622, 2623, and 2624, respectively. In one aspect, provided herein is an antibody that binds CD4, comprising: (i) a VH comprising a VH CDR1, a VH CDR2, and a VH CDR3 having an amino acid sequence of SEQ ID NOs:2625, 2626, and 2627, respectively, and (ii) a VL comprising a VL CDR1, VL CDR2, and VL CDR3 having an amino acid sequence of SEQ ID NOs:2628, 2629, and 2630, respectively. In one aspect, provided herein is an antibody that binds CD4, comprising: (i) a VH comprising a VH CDR1, a VH CDR2, and a VH CDR3 having an amino acid sequence of SEQ ID NOs:2631, 2632, and 2633, respectively, and (ii) a VL comprising a VL CDR1, VL CDR2, and VL CDR3 having an amino acid sequence of SEQ ID NOs:2634, 2635, and 2636, respectively. In one aspect, provided herein is an antibody that binds CD4, comprising: (i) a VH comprising a VH CDR1, a VH CDR2, and a VH CDR3 having an amino acid sequence of SEQ ID NOs:2637, 2638, and 2639, respectively, and (ii) a VL comprising a VL CDR1, VL CDR2, and VL CDR3 having an amino acid sequence of SEQ ID NOs:2640, 2641, and 2642, respectively. In one aspect, provided herein is an antibody that binds CD4, comprising: (i) a VH comprising a VH CDR1, a VH CDR2, and a VH CDR3 having an amino acid sequence of SEQ ID NOs:2643, 2644, and 2645, respectively, and (ii) a VL comprising a VL CDR1, VL CDR2, and VL CDR3 having an amino acid sequence of SEQ ID NOs:2646, 2647, and 2648, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:2649; and (ii) a VL comprising a VL CDR1, a VL CDR2, and a VL CDR3 having an amino acid sequence of a VL CDR1, a VL CDR2, and a VL CDR3, respectively, of SEQ ID NO:2650. In one aspect, provided herein is an antibody that binds CD4, comprising a VH having an amino acid sequence of SEQ ID NO:2649. In one aspect, provided herein is an antibody that binds CD4, comprising a VL having an amino acid sequence of SEQ ID NO:2650. In one aspect, provided herein is an antibody that binds CD4, comprising a VH having an amino acid sequence of SEQ ID NO:2649, and a VL having an amino acid sequence of SEQ ID NO:2650. In one aspect, provided herein is an antibody that binds CD4, comprising a VH having an amino acid sequence having at least 95% identity to an amino acid sequence of SEQ ID NO:2649. In one aspect, provided herein is an antibody that binds CD4, comprising a VL having an amino acid sequence having at least 95% identity to an amino acid sequence of SEQ ID NO:2650. In one aspect, provided herein is an antibody that binds CD4, comprising a VH having an amino acid sequence having at least 95% identity to an amino acid sequence of SEQ ID NO:2649, and a VL having an amino acid sequence having at least 95% identity to an amino acid sequence of SEQ ID NO:2650.

In one aspect, provided herein is an antibody that binds CD4, comprising: (i) a VH comprising a VH CDR1, a VH CDR2, and a VH CDR3 having an amino acid sequence of SEQ ID NOs:2653, 2654, and 2655, respectively, and (ii) a VL comprising a VL CDR1, VL CDR2, and VL CDR3 having an amino acid sequence of SEQ ID NOs:2656, 2657, and 2658, respectively. In one aspect, provided herein is an antibody that binds CD4, comprising: (i) a VH comprising a VH CDR1, a VH CDR2, and a VH CDR3 having an amino acid sequence of SEQ ID NOs:2659, 2660, and 2661, respectively, and (ii) a VL comprising a VL CDR1, VL CDR2, and VL CDR3 having an amino acid sequence of SEQ ID NOs:2662, 2663, and 2664, respectively. In one aspect, provided herein is an antibody that binds CD4, comprising: (i) a VH comprising a VH CDR1, a VH CDR2, and a VH CDR3 having an amino acid sequence of SEQ ID NOs:2665, 2666, and 2667, respectively, and (ii) a VL comprising a VL CDR1, VL CDR2, and VL CDR3 having an amino acid sequence of SEQ ID NOs:2668, 2669, and 2670, respectively. In one aspect, provided herein is an antibody that binds CD4, comprising: (i) a VH comprising a VH CDR1, a VH CDR2, and a VH CDR3 having an amino acid sequence of SEQ ID NOs:2671, 2672, and 2673, respectively, and (ii) a VL comprising a VL CDR1, VL CDR2, and VL CDR3 having an amino acid sequence of SEQ ID NOs:2674, 2675, and 2676, respectively. In one aspect, provided herein is an antibody that binds CD4, comprising: (i) a VH comprising a VH CDR1, a VH CDR2, and a VH CDR3 having an amino acid sequence of SEQ ID NOs:2677, 2678, and 2679, respectively, and (ii) a VL comprising a VL CDR1, VL CDR2, and VL CDR3 having an amino acid sequence of SEQ ID NOs:2680, 2681, and 2682, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:2683; and (ii) a VL comprising a VL CDR1, a VL CDR2, and a VL CDR3 having an amino acid sequence of a VL CDR1, a VL CDR2, and a VL CDR3, respectively, of SEQ ID NO:2684. In one aspect, provided herein is an antibody that binds CD4, comprising a VH having an amino acid sequence of SEQ ID NO:2683. In one aspect, provided herein is an antibody that binds CD4, comprising a VL having an amino acid sequence of SEQ ID NO:2684. In one aspect, provided herein is an antibody that binds CD4, comprising a VH having an amino acid sequence of SEQ ID NO:2683, and a VL having an amino acid sequence of SEQ ID NO:2684. In one aspect, provided herein is an antibody that binds CD4, comprising a VH having an amino acid sequence having at least 95% identity to an amino acid sequence of SEQ ID NO:2683. In one aspect, provided herein is an antibody that binds CD4, comprising a VL having an amino acid sequence having at least 95% identity to an amino acid sequence of SEQ ID NO:2684. In one aspect, provided herein is an antibody that binds CD4, comprising a VH having an amino acid sequence having at least 95% identity to an amino acid sequence of SEQ ID NO:2683, and a VL having an amino acid sequence having at least 95% identity to an amino acid sequence of SEQ ID NO:2684.

In one aspect, provided herein is an antibody that binds CD4, comprising: (i) a VH comprising a VH CDR1, a VH CDR2, and a VH CDR3 having an amino acid sequence of SEQ ID NOs:2687, 2688, and 2689, respectively, and (ii) a VL comprising a VL CDR1, VL CDR2, and VL CDR3 having an amino acid sequence of SEQ ID NOs:2690, 2691, and 2692, respectively. In one aspect, provided herein is an antibody that binds CD4, comprising: (i) a VH comprising a VH CDR1, a VH CDR2, and a VH CDR3 having an amino acid sequence of SEQ ID NOs:2693, 2694, and 2695, respectively, and (ii) a VL comprising a VL CDR1, VL CDR2, and VL CDR3 having an amino acid sequence of SEQ ID NOs:2696, 2697, and 2698, respectively. In one aspect, provided herein is an antibody that binds CD4, comprising: (i) a VH comprising a VH CDR1, a VH CDR2, and a VH CDR3 having an amino acid sequence of SEQ ID NOs:2699, 2700, and 2701, respectively, and (ii) a VL comprising a VL CDR1, VL CDR2, and VL CDR3 having an amino acid sequence of SEQ ID NOs:2702, 2703, and 2704, respectively. In one aspect, provided herein is an antibody that binds CD4, comprising: (i) a VH comprising a VH CDR1, a VH CDR2, and a VH CDR3 having an amino acid sequence of SEQ ID NOs:2705, 2706, and 2707, respectively, and (ii) a VL comprising a VL CDR1, VL CDR2, and VL CDR3 having an amino acid sequence of SEQ ID NOs:2708, 2709, and 2710, respectively. In one aspect, provided herein is an antibody that binds CD4, comprising: (i) a VH comprising a VH CDR1, a VH CDR2, and a VH CDR3 having an amino acid sequence of SEQ ID NOs:2711, 2712, and 2713, respectively, and (ii) a VL comprising a VL CDR1, VL CDR2, and VL CDR3 having an amino acid sequence of SEQ ID NOs:2714, 2715, and 2716, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:2717; and (ii) a VL comprising a VL CDR1, a VL CDR2, and a VL CDR3 having an amino acid sequence of a VL CDR1, a VL CDR2, and a VL CDR3, respectively, of SEQ ID NO:2718. In one aspect, provided herein is an antibody that binds CD4, comprising a VH having an amino acid sequence of SEQ ID NO:2717. In one aspect, provided herein is an antibody that binds CD4, comprising a VL having an amino acid sequence of SEQ ID NO:2718. In one aspect, provided herein is an antibody that binds CD4, comprising a VH having an amino acid sequence of SEQ ID NO:2717, and a VL having an amino acid sequence of SEQ ID NO:2718. In one aspect, provided herein is an antibody that binds CD4, comprising a VH having an amino acid sequence having at least 95% identity to an amino acid sequence of SEQ ID NO:2717. In one aspect, provided herein is an antibody that binds CD4, comprising a VL having an amino acid sequence having at least 95% identity to an amino acid sequence of SEQ ID NO:2718. In one aspect, provided herein is an antibody that binds CD4, comprising a VH having an amino acid sequence having at least 95% identity to an amino acid sequence of SEQ ID NO:2717, and a VL having an amino acid sequence having at least 95% identity to an amino acid sequence of SEQ ID NO:2718.

In one aspect, provided herein is an antibody that binds CD4, comprising: (i) a VH comprising a VH CDR1, a VH CDR2, and a VH CDR3 having an amino acid sequence of SEQ ID NOs:2721, 2722, and 2723, respectively, and (ii) a VL comprising a VL CDR1, VL CDR2, and VL CDR3 having an amino acid sequence of SEQ ID NOs:2724, 2725, and 2726, respectively. In one aspect, provided herein is an antibody that binds CD4, comprising: (i) a VH comprising a VH CDR1, a VH CDR2, and a VH CDR3 having an amino acid sequence of SEQ ID NOs:2727, 2728, and 2729, respectively, and (ii) a VL comprising a VL CDR1, VL CDR2, and VL CDR3 having an amino acid sequence of SEQ ID NOs:2730, 2731, and 2732, respectively. In one aspect, provided herein is an antibody that binds CD4, comprising: (i) a VH comprising a VH CDR1, a VH CDR2, and a VH CDR3 having an amino acid sequence of SEQ ID NOs:2733, 2734, and 2735, respectively, and (ii) a VL comprising a VL CDR1, VL CDR2, and VL CDR3 having an amino acid sequence of SEQ ID NOs:2736, 2737, and 2738, respectively. In one aspect, provided herein is an antibody that binds CD4, comprising: (i) a VH comprising a VH CDR1, a VH CDR2, and a VH CDR3 having an amino acid sequence of SEQ ID NOs:2739, 2740, and 2741, respectively, and (ii) a VL comprising a VL CDR1, VL CDR2, and VL CDR3 having an amino acid sequence of SEQ ID NOs:2742, 2743, and 2744, respectively. In one aspect, provided herein is an antibody that binds CD4, comprising: (i) a VH comprising a VH CDR1, a VH CDR2, and a VH CDR3 having an amino acid sequence of SEQ ID NOs:2745, 2746, and 2747, respectively, and (ii) a VL comprising a VL CDR1, VL CDR2, and VL CDR3 having an amino acid sequence of SEQ ID NOs:2748, 2749, and 2750, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:2751; and (ii) a VL comprising a VL CDR1, a VL CDR2, and a VL CDR3 having an amino acid sequence of a VL CDR1, a VL CDR2, and a VL CDR3, respectively, of SEQ ID NO:2752. In one aspect, provided herein is an antibody that binds CD4, comprising a VH having an amino acid sequence of SEQ ID NO:2751. In one aspect, provided herein is an antibody that binds CD4, comprising a VL having an amino acid sequence of SEQ ID NO:2752. In one aspect, provided herein is an antibody that binds CD4, comprising a VH having an amino acid sequence of SEQ ID NO:2751, and a VL having an amino acid sequence of SEQ ID NO:2752. In one aspect, provided herein is an antibody that binds CD4, comprising a VH having an amino acid sequence having at least 95% identity to an amino acid sequence of SEQ ID NO:2751. In one aspect, provided herein is an antibody that binds CD4, comprising a VL having an amino acid sequence having at least 95% identity to an amino acid sequence of SEQ ID NO:2752. In one aspect, provided herein is an antibody that binds CD4, comprising a VH having an amino acid sequence having at least 95% identity to an amino acid sequence of SEQ ID NO:2751, and a VL having an amino acid sequence having at least 95% identity to an amino acid sequence of SEQ ID NO:2752.

In one aspect, provided herein is an antibody that binds CD4, comprising: (i) a VH comprising a VH CDR1, a VH CDR2, and a VH CDR3 having an amino acid sequence of SEQ ID NOs:2755, 2756, and 2757, respectively, and (ii) a VL comprising a VL CDR1, VL CDR2, and VL CDR3 having an amino acid sequence of SEQ ID NOs:2758, 2759, and 2760, respectively. In one aspect, provided herein is an antibody that binds CD4, comprising: (i) a VH comprising a VH CDR1, a VH CDR2, and a VH CDR3 having an amino acid sequence of SEQ ID NOs:2761, 2762, and 2763, respectively, and (ii) a VL comprising a VL CDR1, VL CDR2, and VL CDR3 having an amino acid sequence of SEQ ID NOs:2764, 2765, and 2766, respectively. In one aspect, provided herein is an antibody that binds CD4, comprising: (i) a VH comprising a VH CDR1, a VH CDR2, and a VH CDR3 having an amino acid sequence of SEQ ID NOs:2767, 2768, and 2769, respectively, and (ii) a VL comprising a VL CDR1, VL CDR2, and VL CDR3 having an amino acid sequence of SEQ ID NOs:2770, 2771, and 2772, respectively. In one aspect, provided herein is an antibody that binds CD4, comprising: (i) a VH comprising a VH CDR1, a VH CDR2, and a VH CDR3 having an amino acid sequence of SEQ ID NOs:2773, 2774, and 2775, respectively, and (ii) a VL comprising a VL CDR1, VL CDR2, and VL CDR3 having an amino acid sequence of SEQ ID NOs:2776, 2777, and 2778, respectively. In one aspect, provided herein is an antibody that binds CD4, comprising: (i) a VH comprising a VH CDR1, a VH CDR2, and a VH CDR3 having an amino acid sequence of SEQ ID NOs:2779, 2780, and 2781, respectively, and (ii) a VL comprising a VL CDR1, VL CDR2, and VL CDR3 having an amino acid sequence of SEQ ID NOs:2782, 2783, and 2784, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:2785; and (ii) a VL comprising a VL CDR1, a VL CDR2, and a VL CDR3 having an amino acid sequence of a VL CDR1, a VL CDR2, and a VL CDR3, respectively, of SEQ ID NO:2786. In one aspect, provided herein is an antibody that binds CD4, comprising a VH having an amino acid sequence of SEQ ID NO:2785. In one aspect, provided herein is an antibody that binds CD4, comprising a VL having an amino acid sequence of SEQ ID NO:2786. In one aspect, provided herein is an antibody that binds CD4, comprising a VH having an amino acid sequence of SEQ ID NO:2785, and a VL having an amino acid sequence of SEQ ID NO:2786. In one aspect, provided herein is an antibody that binds CD4, comprising a VH having an amino acid sequence having at least 95% identity to an amino acid sequence of SEQ ID NO:2785. In one aspect, provided herein is an antibody that binds CD4, comprising a VL having an amino acid sequence having at least 95% identity to an amino acid sequence of SEQ ID NO:2786. In one aspect, provided herein is an antibody that binds CD4, comprising a VH having an amino acid sequence having at least 95% identity to an amino acid sequence of SEQ ID NO:2785, and a VL having an amino acid sequence having at least 95% identity to an amino acid sequence of SEQ ID NO:2786.

In one aspect, provided herein is an antibody that binds CD4, comprising: (i) a VH comprising a VH CDR1, a VH CDR2, and a VH CDR3 having an amino acid sequence of SEQ ID NOs:2789, 2790, and 2791, respectively, and (ii) a VL comprising a VL CDR1, VL CDR2, and VL CDR3 having an amino acid sequence of SEQ ID NOs:2792, 2793, and 2794, respectively. In one aspect, provided herein is an antibody that binds CD4, comprising: (i) a VH comprising a VH CDR1, a VH CDR2, and a VH CDR3 having an amino acid sequence of SEQ ID NOs:2795, 2796, and 2797, respectively, and (ii) a VL comprising a VL CDR1, VL CDR2, and VL CDR3 having an amino acid sequence of SEQ ID NOs:2798, 2799, and 2800, respectively. In one aspect, provided herein is an antibody that binds CD4, comprising: (i) a VH comprising a VH CDR1, a VH CDR2, and a VH CDR3 having an amino acid sequence of SEQ ID NOs:2801, 2802, and 2803, respectively, and (ii) a VL comprising a VL CDR1, VL CDR2, and VL CDR3 having an amino acid sequence of SEQ ID NOs:2804, 2805, and 2806, respectively. In one aspect, provided herein is an antibody that binds CD4, comprising: (i) a VH comprising a VH CDR1, a VH CDR2, and a VH CDR3 having an amino acid sequence of SEQ ID NOs:2807, 2808, and 2809, respectively, and (ii) a VL comprising a VL CDR1, VL CDR2, and VL CDR3 having an amino acid sequence of SEQ ID NOs:2810, 2811, and 2812, respectively. In one aspect, provided herein is an antibody that binds CD4, comprising: (i) a VH comprising a VH CDR1, a VH CDR2, and a VH CDR3 having an amino acid sequence of SEQ ID NOs:2813, 2814, and 2815, respectively, and (ii) a VL comprising a VL CDR1, VL CDR2, and VL CDR3 having an amino acid sequence of SEQ ID NOs:2816, 2817, and 2818, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:2819; and (ii) a VL comprising a VL CDR1, a VL CDR2, and a VL CDR3 having an amino acid sequence of a VL CDR1, a VL CDR2, and a VL CDR3, respectively, of SEQ ID NO:2820. In one aspect, provided herein is an antibody that binds CD4, comprising a VH having an amino acid sequence of SEQ ID NO:2819. In one aspect, provided herein is an antibody that binds CD4, comprising a VL having an amino acid sequence of SEQ ID NO:2820. In one aspect, provided herein is an antibody that binds CD4, comprising a VH having an amino acid sequence of SEQ ID NO:2819, and a VL having an amino acid sequence of SEQ ID NO:2820. In one aspect, provided herein is an antibody that binds CD4, comprising a VH having an amino acid sequence having at least 95% identity to an amino acid sequence of SEQ ID NO:2819. In one aspect, provided herein is an antibody that binds CD4, comprising a VL having an amino acid sequence having at least 95% identity to an amino acid sequence of SEQ ID NO:2820. In one aspect, provided herein is an antibody that binds CD4, comprising a VH having an amino acid sequence having at least 95% identity to an amino acid sequence of SEQ ID NO:2819, and a VL having an amino acid sequence having at least 95% identity to an amino acid sequence of SEQ ID NO:2820.

In one aspect, provided herein is an antibody that binds CD4, comprising: (i) a VH comprising a VH CDR1, a VH CDR2, and a VH CDR3 having an amino acid sequence of SEQ ID NOs:2823, 2824, and 2825, respectively, and (ii) a VL comprising a VL CDR1, VL CDR2, and VL CDR3 having an amino acid sequence of SEQ ID NOs:2826, 2827, and 2828, respectively. In one aspect, provided herein is an antibody that binds CD4, comprising: (i) a VH comprising a VH CDR1, a VH CDR2, and a VH CDR3 having an amino acid sequence of SEQ ID NOs:2829, 2830, and 2831, respectively, and (ii) a VL comprising a VL CDR1, VL CDR2, and VL CDR3 having an amino acid sequence of SEQ ID NOs:2832, 2833, and 2834, respectively. In one aspect, provided herein is an antibody that binds CD4, comprising: (i) a VH comprising a VH CDR1, a VH CDR2, and a VH CDR3 having an amino acid sequence of SEQ ID NOs:2835, 2836, and 2837, respectively, and (ii) a VL comprising a VL CDR1, VL CDR2, and VL CDR3 having an amino acid sequence of SEQ ID NOs:2838, 2839, and 2840, respectively. In one aspect, provided herein is an antibody that binds CD4, comprising: (i) a VH comprising a VH CDR1, a VH CDR2, and a VH CDR3 having an amino acid sequence of SEQ ID NOs:2841, 2842, and 2843, respectively, and (ii) a VL comprising a VL CDR1, VL CDR2, and VL CDR3 having an amino acid sequence of SEQ ID NOs:2844, 2845, and 2846, respectively. In one aspect, provided herein is an antibody that binds CD4, comprising: (i) a VH comprising a VH CDR1, a VH CDR2, and a VH CDR3 having an amino acid sequence of SEQ ID NOs:2847, 2848, and 2849, respectively, and (ii) a VL comprising a VL CDR1, VL CDR2, and VL CDR3 having an amino acid sequence of SEQ ID NOs:2850, 2851, and 2852, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:2853; and (ii) a VL comprising a VL CDR1, a VL CDR2, and a VL CDR3 having an amino acid sequence of a VL CDR1, a VL CDR2, and a VL CDR3, respectively, of SEQ ID NO:2854. In one aspect, provided herein is an antibody that binds CD4, comprising a VH having an amino acid sequence of SEQ ID NO:2853. In one aspect, provided herein is an antibody that binds CD4, comprising a VL having an amino acid sequence of SEQ ID NO:2854. In one aspect, provided herein is an antibody that binds CD4, comprising a VH having an amino acid sequence of SEQ ID NO:2853, and a VL having an amino acid sequence of SEQ ID NO:2854. In one aspect, provided herein is an antibody that binds CD4, comprising a VH having an amino acid sequence having at least 95% identity to an amino acid sequence of SEQ ID NO:2853. In one aspect, provided herein is an antibody that binds CD4, comprising a VL having an amino acid sequence having at least 95% identity to an amino acid sequence of SEQ ID NO:2854. In one aspect, provided herein is an antibody that binds CD4, comprising a VH having an amino acid sequence having at least 95% identity to an amino acid sequence of SEQ ID NO:2853, and a VL having an amino acid sequence having at least 95% identity to an amino acid sequence of SEQ ID NO:2854.

In one aspect, provided herein is an antibody that binds CD4, comprising: (i) a VH comprising a VH CDR1, a VH CDR2, and a VH CDR3 having an amino acid sequence of SEQ ID NOs:2857, 2858, and 2859, respectively, and (ii) a VL comprising a VL CDR1, VL CDR2, and VL CDR3 having an amino acid sequence of SEQ ID NOs:2860, 2861, and 2862, respectively. In one aspect, provided herein is an antibody that binds CD4, comprising: (i) a VH comprising a VH CDR1, a VH CDR2, and a VH CDR3 having an amino acid sequence of SEQ ID NOs:2863, 2864, and 2865, respectively, and (ii) a VL comprising a VL CDR1, VL CDR2, and VL CDR3 having an amino acid sequence of SEQ ID NOs:2866, 2867, and 2868, respectively. In one aspect, provided herein is an antibody that binds CD4, comprising: (i) a VH comprising a VH CDR1, a VH CDR2, and a VH CDR3 having an amino acid sequence of SEQ ID NOs:2869, 2870, and 2871, respectively, and (ii) a VL comprising a VL CDR1, VL CDR2, and VL CDR3 having an amino acid sequence of SEQ ID NOs:2872, 2873, and 2874, respectively. In one aspect, provided herein is an antibody that binds CD4, comprising: (i) a VH comprising a VH CDR1, a VH CDR2, and a VH CDR3 having an amino acid sequence of SEQ ID NOs:2875, 2876, and 2877, respectively, and (ii) a VL comprising a VL CDR1, VL CDR2, and VL CDR3 having an amino acid sequence of SEQ ID NOs:2878, 2879, and 2880, respectively. In one aspect, provided herein is an antibody that binds CD4, comprising: (i) a VH comprising a VH CDR1, a VH CDR2, and a VH CDR3 having an amino acid sequence of SEQ ID NOs:2881, 2882, and 2883, respectively, and (ii) a VL comprising a VL CDR1, VL CDR2, and VL CDR3 having an amino acid sequence of SEQ ID NOs:2884, 2885, and 2886, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:2887; and (ii) a VL comprising a VL CDR1, a VL CDR2, and a VL CDR3 having an amino acid sequence of a VL CDR1, a VL CDR2, and a VL CDR3, respectively, of SEQ ID NO:2888. In one aspect, provided herein is an antibody that binds CD4, comprising a VH having an amino acid sequence of SEQ ID NO:2887. In one aspect, provided herein is an antibody that binds CD4, comprising a VL having an amino acid sequence of SEQ ID NO:2888. In one aspect, provided herein is an antibody that binds CD4, comprising a VH having an amino acid sequence of SEQ ID NO:2887, and a VL having an amino acid sequence of SEQ ID NO:2888. In one aspect, provided herein is an antibody that binds CD4, comprising a VH having an amino acid sequence having at least 95% identity to an amino acid sequence of SEQ ID NO:2887. In one aspect, provided herein is an antibody that binds CD4, comprising a VL having an amino acid sequence having at least 95% identity to an amino acid sequence of SEQ ID NO:2888. In one aspect, provided herein is an antibody that binds CD4, comprising a VH having an amino acid sequence having at least 95% identity to an amino acid sequence of SEQ ID NO:2887, and a VL having an amino acid sequence having at least 95% identity to an amino acid sequence of SEQ ID NO:2888.

In one aspect, provided herein is an antibody that binds CD4, comprising: (i) a VH comprising a VH CDR1, a VH CDR2, and a VH CDR3 having an amino acid sequence of SEQ ID NOs:2891, 2892, and 2893, respectively, and (ii) a VL comprising a VL CDR1, VL CDR2, and VL CDR3 having an amino acid sequence of SEQ ID NOs:2894, 2895, and 2896, respectively. In one aspect, provided herein is an antibody that binds CD4, comprising: (i) a VH comprising a VH CDR1, a VH CDR2, and a VH CDR3 having an amino acid sequence of SEQ ID NOs:2897, 2898, and 2899, respectively, and (ii) a VL comprising a VL CDR1, VL CDR2, and VL CDR3 having an amino acid sequence of SEQ ID NOs:2900, 2901, and 2902, respectively. In one aspect, provided herein is an antibody that binds CD4, comprising: (i) a VH comprising a VH CDR1, a VH CDR2, and a VH CDR3 having an amino acid sequence of SEQ ID NOs:2903, 2904, and 2905, respectively, and (ii) a VL comprising a VL CDR1, VL CDR2, and VL CDR3 having an amino acid sequence of SEQ ID NOs:2906, 2907, and 2908, respectively. In one aspect, provided herein is an antibody that binds CD4, comprising: (i) a VH comprising a VH CDR1, a VH CDR2, and a VH CDR3 having an amino acid sequence of SEQ ID NOs:2909, 2910, and 2911, respectively, and (ii) a VL comprising a VL CDR1, VL CDR2, and VL CDR3 having an amino acid sequence of SEQ ID NOs:2912, 2913, and 2914, respectively. In one aspect, provided herein is an antibody that binds CD4, comprising: (i) a VH comprising a VH CDR1, a VH CDR2, and a VH CDR3 having an amino acid sequence of SEQ ID NOs:2915, 2916, and 2917, respectively, and (ii) a VL comprising a VL CDR1, VL CDR2, and VL CDR3 having an amino acid sequence of SEQ ID NOs:2918, 2919, and 2920, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:2921; and (ii) a VL comprising a VL CDR1, a VL CDR2, and a VL CDR3 having an amino acid sequence of a VL CDR1, a VL CDR2, and a VL CDR3, respectively, of SEQ ID NO:2922. In one aspect, provided herein is an antibody that binds CD4, comprising a VH having an amino acid sequence of SEQ ID NO:2921. In one aspect, provided herein is an antibody that binds CD4, comprising a VL having an amino acid sequence of SEQ ID NO:2922. In one aspect, provided herein is an antibody that binds CD4, comprising a VH having an amino acid sequence of SEQ ID NO:2921, and a VL having an amino acid sequence of SEQ ID NO:2922. In one aspect, provided herein is an antibody that binds CD4, comprising a VH having an amino acid sequence having at least 95% identity to an amino acid sequence of SEQ ID NO:2921. In one aspect, provided herein is an antibody that binds CD4, comprising a VL having an amino acid sequence having at least 95% identity to an amino acid sequence of SEQ ID NO:2922. In one aspect, provided herein is an antibody that binds CD4, comprising a VH having an amino acid sequence having at least 95% identity to an amino acid sequence of SEQ ID NO:2921, and a VL having an amino acid sequence having at least 95% identity to an amino acid sequence of SEQ ID NO:2922.

In one aspect, provided herein is an antibody that binds CD4, comprising: (i) a VH comprising a VH CDR1, a VH CDR2, and a VH CDR3 having an amino acid sequence of SEQ ID NOs:2925, 2926, and 2927, respectively, and (ii) a VL comprising a VL CDR1, VL CDR2, and VL CDR3 having an amino acid sequence of SEQ ID NOs:2928, 2929, and 2930, respectively. In one aspect, provided herein is an antibody that binds CD4, comprising: (i) a VH comprising a VH CDR1, a VH CDR2, and a VH CDR3 having an amino acid sequence of SEQ ID NOs:2931, 2932, and 2933, respectively, and (ii) a VL comprising a VL CDR1, VL CDR2, and VL CDR3 having an amino acid sequence of SEQ ID NOs:2934, 2935, and 2936, respectively. In one aspect, provided herein is an antibody that binds CD4, comprising: (i) a VH comprising a VH CDR1, a VH CDR2, and a VH CDR3 having an amino acid sequence of SEQ ID NOs:2937, 2938, and 2939, respectively, and (ii) a VL comprising a VL CDR1, VL CDR2, and VL CDR3 having an amino acid sequence of SEQ ID NOs:2940, 2941, and 2942, respectively. In one aspect, provided herein is an antibody that binds CD4, comprising: (i) a VH comprising a VH CDR1, a VH CDR2, and a VH CDR3 having an amino acid sequence of SEQ ID NOs:2943, 2944, and 2945, respectively, and (ii) a VL comprising a VL CDR1, VL CDR2, and VL CDR3 having an amino acid sequence of SEQ ID NOs:2946, 2947, and 2948, respectively. In one aspect, provided herein is an antibody that binds CD4, comprising: (i) a VH comprising a VH CDR1, a VH CDR2, and a VH CDR3 having an amino acid sequence of SEQ ID NOs:2949, 2950, and 2951, respectively, and (ii) a VL comprising a VL CDR1, VL CDR2, and VL CDR3 having an amino acid sequence of SEQ ID NOs:2952, 2953, and 2954, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:2955; and (ii) a VL comprising a VL CDR1, a VL CDR2, and a VL CDR3 having an amino acid sequence of a VL CDR1, a VL CDR2, and a VL CDR3, respectively, of SEQ ID NO:2956. In one aspect, provided herein is an antibody that binds CD4, comprising a VH having an amino acid sequence of SEQ ID NO:2955. In one aspect, provided herein is an antibody that binds CD4, comprising a VL having an amino acid sequence of SEQ ID NO:2956. In one aspect, provided herein is an antibody that binds CD4, comprising a VH having an amino acid sequence of SEQ ID NO:2955, and a VL having an amino acid sequence of SEQ ID NO:2956. In one aspect, provided herein is an antibody that binds CD4, comprising a VH having an amino acid sequence having at least 95% identity to an amino acid sequence of SEQ ID NO:2955. In one aspect, provided herein is an antibody that binds CD4, comprising a VL having an amino acid sequence having at least 95% identity to an amino acid sequence of SEQ ID NO:2956. In one aspect, provided herein is an antibody that binds CD4, comprising a VH having an amino acid sequence having at least 95% identity to an amino acid sequence of SEQ ID NO:2955, and a VL having an amino acid sequence having at least 95% identity to an amino acid sequence of SEQ ID NO:2956.

In one aspect, provided herein is an antibody that binds CD4, comprising: (i) a VH comprising a VH CDR1, a VH CDR2, and a VH CDR3 having an amino acid sequence of SEQ ID NOs:2959, 2960, and 2961, respectively, and (ii) a VL comprising a VL CDR1, VL CDR2, and VL CDR3 having an amino acid sequence of SEQ ID NOs:2962, 2963, and 2964, respectively. In one aspect, provided herein is an antibody that binds CD4, comprising: (i) a VH comprising a VH CDR1, a VH CDR2, and a VH CDR3 having an amino acid sequence of SEQ ID NOs:2965, 2966, and 2967, respectively, and (ii) a VL comprising a VL CDR1, VL CDR2, and VL CDR3 having an amino acid sequence of SEQ ID NOs:2968, 2969, and 2970, respectively. In one aspect, provided herein is an antibody that binds CD4, comprising: (i) a VH comprising a VH CDR1, a VH CDR2, and a VH CDR3 having an amino acid sequence of SEQ ID NOs:2971, 2972, and 2973, respectively, and (ii) a VL comprising a VL CDR1, VL CDR2, and VL CDR3 having an amino acid sequence of SEQ ID NOs:2974, 2975, and 2976, respectively. In one aspect, provided herein is an antibody that binds CD4, comprising: (i) a VH comprising a VH CDR1, a VH CDR2, and a VH CDR3 having an amino acid sequence of SEQ ID NOs:2977, 2978, and 2979, respectively, and (ii) a VL comprising a VL CDR1, VL CDR2, and VL CDR3 having an amino acid sequence of SEQ ID NOs:2980, 2981, and 2982, respectively. In one aspect, provided herein is an antibody that binds CD4, comprising: (i) a VH comprising a VH CDR1, a VH CDR2, and a VH CDR3 having an amino acid sequence of SEQ ID NOs:2983, 2984, and 2985, respectively, and (ii) a VL comprising a VL CDR1, VL CDR2, and VL CDR3 having an amino acid sequence of SEQ ID NOs:2986, 2987, and 2988, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:2989; and (ii) a VL comprising a VL CDR1, a VL CDR2, and a VL CDR3 having an amino acid sequence of a VL CDR1, a VL CDR2, and a VL CDR3, respectively, of SEQ ID NO:2990. In one aspect, provided herein is an antibody that binds CD4, comprising a VH having an amino acid sequence of SEQ ID NO:2989. In one aspect, provided herein is an antibody that binds CD4, comprising a VL having an amino acid sequence of SEQ ID NO:2990. In one aspect, provided herein is an antibody that binds CD4, comprising a VH having an amino acid sequence of SEQ ID NO:2989, and a VL having an amino acid sequence of SEQ ID NO:2990. In one aspect, provided herein is an antibody that binds CD4, comprising a heavy chain having an amino acid sequence of SEQ ID NO:2991. In one aspect, provided herein is an antibody that binds CD4, comprising a light chain having an amino acid sequence of SEQ ID NO:2992. In one aspect, provided herein is an antibody that binds CD4, comprising a heavy chain having an amino acid sequence of SEQ ID NO:2991, and a light chain having an amino acid sequence of SEQ ID NO:2992. In one aspect, provided herein is an antibody that binds CD4, comprising a VH having an amino acid sequence having at least 95% identity to an amino acid sequence of SEQ ID NO:2989. In one aspect, provided herein is an antibody that binds CD4, comprising a VL having an amino acid sequence having at least 95% identity to an amino acid sequence of SEQ ID NO:2990. In one aspect, provided herein is an antibody that binds CD4, comprising a VH having an amino acid sequence having at least 95% identity to an amino acid sequence of SEQ ID NO:2989, and a VL having an amino acid sequence having at least 95% identity to an amino acid sequence of SEQ ID NO:2990. In one aspect, provided herein is an antibody that binds CD4, comprising a heavy chain having an amino acid sequence having at least 95% identity to an amino acid sequence of SEQ ID NO:2991. In one aspect, provided herein is an antibody that binds CD4, comprising a light chain having an amino acid sequence having at least 95% identity to an amino acid sequence of SEQ ID NO:2992. In one aspect, provided herein is an antibody that binds CD4, comprising a heavy chain having an amino acid sequence having at least 95% identity to an amino acid sequence of SEQ ID NO:2991, and a light chain having an amino acid sequence having at least 95% identity to an amino acid sequence of SEQ ID NO:2992.

In one aspect, provided herein is an antibody that binds CD4, comprising: (i) a VH comprising a VH CDR1, a VH CDR2, and a VH CDR3 having an amino acid sequence of SEQ ID NOs:2993, 2994, and 2995, respectively, and (ii) a VL comprising a VL CDR1, VL CDR2, and VL CDR3 having an amino acid sequence of SEQ ID NOs:2996, 2997, and 2998, respectively. In one aspect, provided herein is an antibody that binds CD4, comprising: (i) a VH comprising a VH CDR1, a VH CDR2, and a VH CDR3 having an amino acid sequence of SEQ ID NOs:2999, 3000, and 3001, respectively, and (ii) a VL comprising a VL CDR1, VL CDR2, and VL CDR3 having an amino acid sequence of SEQ ID NOs:3002, 3003, and 3004, respectively. In one aspect, provided herein is an antibody that binds CD4, comprising: (i) a VH comprising a VH CDR1, a VH CDR2, and a VH CDR3 having an amino acid sequence of SEQ ID NOs:3005, 3006, and 3007, respectively, and (ii) a VL comprising a VL CDR1, VL CDR2, and VL CDR3 having an amino acid sequence of SEQ ID NOs:3008, 3009, and 3010, respectively. In one aspect, provided herein is an antibody that binds CD4, comprising: (i) a VH comprising a VH CDR1, a VH CDR2, and a VH CDR3 having an amino acid sequence of SEQ ID NOs:3011, 3012, and 3013, respectively, and (ii) a VL comprising a VL CDR1, VL CDR2, and VL CDR3 having an amino acid sequence of SEQ ID NOs:3014, 3015, and 3016, respectively. In one aspect, provided herein is an antibody that binds CD4, comprising: (i) a VH comprising a VH CDR1, a VH CDR2, and a VH CDR3 having an amino acid sequence of SEQ ID NOs:3017, 3018, and 3019, respectively, and (ii) a VL comprising a VL CDR1, VL CDR2, and VL CDR3 having an amino acid sequence of SEQ ID NOs:3020, 3021, and 3022, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:3023; and (ii) a VL comprising a VL CDR1, a VL CDR2, and a VL CDR3 having an amino acid sequence of a VL CDR1, a VL CDR2, and a VL CDR3, respectively, of SEQ ID NO:3024. In one aspect, provided herein is an antibody that binds CD4, comprising a VH having an amino acid sequence of SEQ ID NO:3023. In one aspect, provided herein is an antibody that binds CD4, comprising a VL having an amino acid sequence of SEQ ID NO:3024. In one aspect, provided herein is an antibody that binds CD4, comprising a VH having an amino acid sequence of SEQ ID NO:3023, and a VL having an amino acid sequence of SEQ ID NO:3024. In one aspect, provided herein is an antibody that binds CD4, comprising a heavy chain having an amino acid sequence of SEQ ID NO:3025. In one aspect, provided herein is an antibody that binds CD4, comprising a light chain having an amino acid sequence of SEQ ID NO:3026. In one aspect, provided herein is an antibody that binds CD4, comprising a heavy chain having an amino acid sequence of SEQ ID NO:3025, and a light chain having an amino acid sequence of SEQ ID NO:3026. In one aspect, provided herein is an antibody that binds CD4, comprising a VH having an amino acid sequence having at least 95% identity to an amino acid sequence of SEQ ID NO:3023. In one aspect, provided herein is an antibody that binds CD4, comprising a VL having an amino acid sequence having at least 95% identity to an amino acid sequence of SEQ ID NO:3024. In one aspect, provided herein is an antibody that binds CD4, comprising a VH having an amino acid sequence having at least 95% identity to an amino acid sequence of SEQ ID NO:3023, and a VL having an amino acid sequence having at least 95% identity to an amino acid sequence of SEQ ID NO:3024. In one aspect, provided herein is an antibody that binds CD4, comprising a heavy chain having an amino acid sequence having at least 95% identity to an amino acid sequence of SEQ ID NO:3025. In one aspect, provided herein is an antibody that binds CD4, comprising a light chain having an amino acid sequence having at least 95% identity to an amino acid sequence of SEQ ID NO:3026. In one aspect, provided herein is an antibody that binds CD4, comprising a heavy chain having an amino acid sequence having at least 95% identity to an amino acid sequence of SEQ ID NO:3025, and a light chain having an amino acid sequence having at least 95% identity to an amino acid sequence of SEQ ID NO:3026.

In one aspect, provided herein is an antibody that binds CD4, comprising: (i) a VH comprising a VH CDR1, a VH CDR2, and a VH CDR3 having an amino acid sequence of SEQ ID NOs:3027, 3028, and 3029, respectively, and (ii) a VL comprising a VL CDR1, VL CDR2, and VL CDR3 having an amino acid sequence of SEQ ID NOs:3030, 3031, and 3032, respectively. In one aspect, provided herein is an antibody that binds CD4, comprising: (i) a VH comprising a VH CDR1, a VH CDR2, and a VH CDR3 having an amino acid sequence of SEQ ID NOs:3033, 3034, and 3035, respectively, and (ii) a VL comprising a VL CDR1, VL CDR2, and VL CDR3 having an amino acid sequence of SEQ ID NOs:3036, 3037, and 3038, respectively. In one aspect, provided herein is an antibody that binds CD4, comprising: (i) a VH comprising a VH CDR1, a VH CDR2, and a VH CDR3 having an amino acid sequence of SEQ ID NOs:3039, 3040, and 3041, respectively, and (ii) a VL comprising a VL CDR1, VL CDR2, and VL CDR3 having an amino acid sequence of SEQ ID NOs:3042, 3043, and 3044, respectively. In one aspect, provided herein is an antibody that binds CD4, comprising: (i) a VH comprising a VH CDR1, a VH CDR2, and a VH CDR3 having an amino acid sequence of SEQ ID NOs:3045, 3046, and 3047, respectively, and (ii) a VL comprising a VL CDR1, VL CDR2, and VL CDR3 having an amino acid sequence of SEQ ID NOs:3048, 3049, and 3050, respectively. In one aspect, provided herein is an antibody that binds CD4, comprising: (i) a VH comprising a VH CDR1, a VH CDR2, and a VH CDR3 having an amino acid sequence of SEQ ID NOs:3051, 3052, and 3053, respectively, and (ii) a VL comprising a VL CDR1, VL CDR2, and VL CDR3 having an amino acid sequence of SEQ ID NOs:3054, 3055, and 3056, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:3057; and (ii) a VL comprising a VL CDR1, a VL CDR2, and a VL CDR3 having an amino acid sequence of a VL CDR1, a VL CDR2, and a VL CDR3, respectively, of SEQ ID NO:3058. In one aspect, provided herein is an antibody that binds CD4, comprising a VH having an amino acid sequence of SEQ ID NO:3057. In one aspect, provided herein is an antibody that binds CD4, comprising a VL having an amino acid sequence of SEQ ID NO:3058. In one aspect, provided herein is an antibody that binds CD4, comprising a VH having an amino acid sequence of SEQ ID NO:3057, and a VL having an amino acid sequence of SEQ ID NO:3058. In one aspect, provided herein is an antibody that binds CD4, comprising a VH having an amino acid sequence having at least 95% identity to an amino acid sequence of SEQ ID NO:3057. In one aspect, provided herein is an antibody that binds CD4, comprising a VL having an amino acid sequence having at least 95% identity to an amino acid sequence of SEQ ID NO:3058. In one aspect, provided herein is an antibody that binds CD4, comprising a VH having an amino acid sequence having at least 95% identity to an amino acid sequence of SEQ ID NO:3057, and a VL having an amino acid sequence having at least 95% identity to an amino acid sequence of SEQ ID NO:3058.

In one aspect, provided herein is an antibody that binds CD4, comprising: (i) a VH comprising a VH CDR1, a VH CDR2, and a VH CDR3 having an amino acid sequence of SEQ ID NOs:3061, 3062, and 3063, respectively, and (ii) a VL comprising a VL CDR1, VL CDR2, and VL CDR3 having an amino acid sequence of SEQ ID NOs:3064, 3065, and 3066, respectively. In one aspect, provided herein is an antibody that binds CD4, comprising: (i) a VH comprising a VH CDR1, a VH CDR2, and a VH CDR3 having an amino acid sequence of SEQ ID NOs:3067, 3068, and 3069, respectively, and (ii) a VL comprising a VL CDR1, VL CDR2, and VL CDR3 having an amino acid sequence of SEQ ID NOs:3070, 3071, and 3072, respectively. In one aspect, provided herein is an antibody that binds CD4, comprising: (i) a VH comprising a VH CDR1, a VH CDR2, and a VH CDR3 having an amino acid sequence of SEQ ID NOs:3073, 3074, and 3075, respectively, and (ii) a VL comprising a VL CDR1, VL CDR2, and VL CDR3 having an amino acid sequence of SEQ ID NOs:3076, 3077, and 3078, respectively. In one aspect, provided herein is an antibody that binds CD4, comprising: (i) a VH comprising a VH CDR1, a VH CDR2, and a VH CDR3 having an amino acid sequence of SEQ ID NOs:3079, 3080, and 3081, respectively, and (ii) a VL comprising a VL CDR1, VL CDR2, and VL CDR3 having an amino acid sequence of SEQ ID NOs:3082, 3083, and 3084, respectively. In one aspect, provided herein is an antibody that binds CD4, comprising: (i) a VH comprising a VH CDR1, a VH CDR2, and a VH CDR3 having an amino acid sequence of SEQ ID NOs:3085, 3086, and 3087, respectively, and (ii) a VL comprising a VL CDR1, VL CDR2, and VL CDR3 having an amino acid sequence of SEQ ID NOs:3088, 3089, and 3090, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:3091; and (ii) a VL comprising a VL CDR1, a VL CDR2, and a VL CDR3 having an amino acid sequence of a VL CDR1, a VL CDR2, and a VL CDR3, respectively, of SEQ ID NO:3092. In one aspect, provided herein is an antibody that binds CD4, comprising a VH having an amino acid sequence of SEQ ID NO:3091. In one aspect, provided herein is an antibody that binds CD4, comprising a VL having an amino acid sequence of SEQ ID NO:3092. In one aspect, provided herein is an antibody that binds CD4, comprising a VH having an amino acid sequence of SEQ ID NO:3091, and a VL having an amino acid sequence of SEQ ID NO:3092. In one aspect, provided herein is an antibody that binds CD4, comprising a heavy chain having an amino acid sequence of SEQ ID NO:3093. In one aspect, provided herein is an antibody that binds CD4, comprising a light chain having an amino acid sequence of SEQ ID NO:3094. In one aspect, provided herein is an antibody that binds CD4, comprising a heavy chain having an amino acid sequence of SEQ ID NO:3093, and a light chain having an amino acid sequence of SEQ ID NO:3094. In one aspect, provided herein is an antibody that binds CD4, comprising a VH having an amino acid sequence having at least 95% identity to an amino acid sequence of SEQ ID NO:3091. In one aspect, provided herein is an antibody that binds CD4, comprising a VL having an amino acid sequence having at least 95% identity to an amino acid sequence of SEQ ID NO:3092. In one aspect, provided herein is an antibody that binds CD4, comprising a VH having an amino acid sequence having at least 95% identity to an amino acid sequence of SEQ ID NO:3091, and a VL having an amino acid sequence having at least 95% identity to an amino acid sequence of SEQ ID NO:3092. In one aspect, provided herein is an antibody that binds CD4, comprising a heavy chain having an amino acid sequence having at least 95% identity to an amino acid sequence of SEQ ID NO:3093. In one aspect, provided herein is an antibody that binds CD4, comprising a light chain having an amino acid sequence having at least 95% identity to an amino acid sequence of SEQ ID NO:3094. In one aspect, provided herein is an antibody that binds CD4, comprising a heavy chain having an amino acid sequence having at least 95% identity to an amino acid sequence of SEQ ID NO:3093, and a light chain having an amino acid sequence having at least 95% identity to an amino acid sequence of SEQ ID NO:3094.

In one aspect, provided herein is an antibody that binds CD4, comprising: (i) a VH comprising a VH CDR1, a VH CDR2, and a VH CDR3 having an amino acid sequence of SEQ ID NOs:3095, 3096, and 3097, respectively, and (ii) a VL comprising a VL CDR1, VL CDR2, and VL CDR3 having an amino acid sequence of SEQ ID NOs:3098, 3099, and 3100, respectively. In one aspect, provided herein is an antibody that binds CD4, comprising: (i) a VH comprising a VH CDR1, a VH CDR2, and a VH CDR3 having an amino acid sequence of SEQ ID NOs:3101, 3102, and 3103, respectively, and (ii) a VL comprising a VL CDR1, VL CDR2, and VL CDR3 having an amino acid sequence of SEQ ID NOs:3104, 3105, and 3106, respectively. In one aspect, provided herein is an antibody that binds CD4, comprising: (i) a VH comprising a VH CDR1, a VH CDR2, and a VH CDR3 having an amino acid sequence of SEQ ID NOs:3107, 3108, and 3109, respectively, and (ii) a VL comprising a VL CDR1, VL CDR2, and VL CDR3 having an amino acid sequence of SEQ ID NOs:3110, 3111, and 3112, respectively. In one aspect, provided herein is an antibody that binds CD4, comprising: (i) a VH comprising a VH CDR1, a VH CDR2, and a VH CDR3 having an amino acid sequence of SEQ ID NOs:3113, 3114, and 3115, respectively, and (ii) a VL comprising a VL CDR1, VL CDR2, and VL CDR3 having an amino acid sequence of SEQ ID NOs:3116, 3117, and 3118, respectively. In one aspect, provided herein is an antibody that binds CD4, comprising: (i) a VH comprising a VH CDR1, a VH CDR2, and a VH CDR3 having an amino acid sequence of SEQ ID NOs:3119, 3120, and 3121, respectively, and (ii) a VL comprising a VL CDR1, VL CDR2, and VL CDR3 having an amino acid sequence of SEQ ID NOs:3122, 3123, and 3124, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:3125; and (ii) a VL comprising a VL CDR1, a VL CDR2, and a VL CDR3 having an amino acid sequence of a VL CDR1, a VL CDR2, and a VL CDR3, respectively, of SEQ ID NO:3126. In one aspect, provided herein is an antibody that binds CD4, comprising a VH having an amino acid sequence of SEQ ID NO:3125. In one aspect, provided herein is an antibody that binds CD4, comprising a VL having an amino acid sequence of SEQ ID NO:3126. In one aspect, provided herein is an antibody that binds CD4, comprising a VH having an amino acid sequence of SEQ ID NO:3125, and a VL having an amino acid sequence of SEQ ID NO:3126. In one aspect, provided herein is an antibody that binds CD4, comprising a VH having an amino acid sequence having at least 95% identity to an amino acid sequence of SEQ ID NO:3125. In one aspect, provided herein is an antibody that binds CD4, comprising a VL having an amino acid sequence having at least 95% identity to an amino acid sequence of SEQ ID NO:3126. In one aspect, provided herein is an antibody that binds CD4, comprising a VH having an amino acid sequence having at least 95% identity to an amino acid sequence of SEQ ID NO:3125, and a VL having an amino acid sequence having at least 95% identity to an amino acid sequence of SEQ ID NO:3126.

In one aspect, provided herein is an antibody that binds CD4, comprising: (i) a VH comprising a VH CDR1, a VH CDR2, and a VH CDR3 having an amino acid sequence of SEQ ID NOs:3129, 3130, and 3131, respectively, and (ii) a VL comprising a VL CDR1, VL CDR2, and VL CDR3 having an amino acid sequence of SEQ ID NOs:3132, 3133, and 3134, respectively. In one aspect, provided herein is an antibody that binds CD4, comprising: (i) a VH comprising a VH CDR1, a VH CDR2, and a VH CDR3 having an amino acid sequence of SEQ ID NOs:3135, 3136, and 3137, respectively, and (ii) a VL comprising a VL CDR1, VL CDR2, and VL CDR3 having an amino acid sequence of SEQ ID NOs:3138, 3139, and 3140, respectively. In one aspect, provided herein is an antibody that binds CD4, comprising: (i) a VH comprising a VH CDR1, a VH CDR2, and a VH CDR3 having an amino acid sequence of SEQ ID NOs:3141, 3142, and 3143, respectively, and (ii) a VL comprising a VL CDR1, VL CDR2, and VL CDR3 having an amino acid sequence of SEQ ID NOs:3144, 3145, and 3146, respectively. In one aspect, provided herein is an antibody that binds CD4, comprising: (i) a VH comprising a VH CDR1, a VH CDR2, and a VH CDR3 having an amino acid sequence of SEQ ID NOs:3147, 3148, and 3149, respectively, and (ii) a VL comprising a VL CDR1, VL CDR2, and VL CDR3 having an amino acid sequence of SEQ ID NOs:3150, 3151, and 3152, respectively. In one aspect, provided herein is an antibody that binds CD4, comprising: (i) a VH comprising a VH CDR1, a VH CDR2, and a VH CDR3 having an amino acid sequence of SEQ ID NOs:3153, 3154, and 3155, respectively, and (ii) a VL comprising a VL CDR1, VL CDR2, and VL CDR3 having an amino acid sequence of SEQ ID NOs:3156, 3157, and 3158, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:3159; and (ii) a VL comprising a VL CDR1, a VL CDR2, and a VL CDR3 having an amino acid sequence of a VL CDR1, a VL CDR2, and a VL CDR3, respectively, of SEQ ID NO:3160. In one aspect, provided herein is an antibody that binds CD4, comprising a VH having an amino acid sequence of SEQ ID NO:3159. In one aspect, provided herein is an antibody that binds CD4, comprising a VL having an amino acid sequence of SEQ ID NO:3160. In one aspect, provided herein is an antibody that binds CD4, comprising a VH having an amino acid sequence of SEQ ID NO:3159, and a VL having an amino acid sequence of SEQ ID NO:3160. In one aspect, provided herein is an antibody that binds CD4, comprising a heavy chain having an amino acid sequence of SEQ ID NO:3161. In one aspect, provided herein is an antibody that binds CD4, comprising a light chain having an amino acid sequence of SEQ ID NO:3162. In one aspect, provided herein is an antibody that binds CD4, comprising a heavy chain having an amino acid sequence of SEQ ID NO:3161, and a light chain having an amino acid sequence of SEQ ID NO:3162. In one aspect, provided herein is an antibody that binds CD4, comprising a VH having an amino acid sequence having at least 95% identity to an amino acid sequence of SEQ ID NO:3159. In one aspect, provided herein is an antibody that binds CD4, comprising a VL having an amino acid sequence having at least 95% identity to an amino acid sequence of SEQ ID NO:3160. In one aspect, provided herein is an antibody that binds CD4, comprising a VH having an amino acid sequence having at least 95% identity to an amino acid sequence of SEQ ID NO:3159, and a VL having an amino acid sequence having at least 95% identity to an amino acid sequence of SEQ ID NO:3160. In one aspect, provided herein is an antibody that binds CD4, comprising a heavy chain having an amino acid sequence having at least 95% identity to an amino acid sequence of SEQ ID NO:3161. In one aspect, provided herein is an antibody that binds CD4, comprising a light chain having an amino acid sequence having at least 95% identity to an amino acid sequence of SEQ ID NO:3162. In one aspect, provided herein is an antibody that binds CD4, comprising a heavy chain having an amino acid sequence having at least 95% identity to an amino acid sequence of SEQ ID NO:3161, and a light chain having an amino acid sequence having at least 95% identity to an amino acid sequence of SEQ ID NO:3162.

In one aspect, provided herein is an antibody that binds CD4, comprising: (i) a VH comprising a VH CDR1, a VH CDR2, and a VH CDR3 having an amino acid sequence of SEQ ID NOs:3163, 3164, and 3165, respectively, and (ii) a VL comprising a VL CDR1, VL CDR2, and VL CDR3 having an amino acid sequence of SEQ ID NOs:3166, 3167, and 3168, respectively. In one aspect, provided herein is an antibody that binds CD4, comprising: (i) a VH comprising a VH CDR1, a VH CDR2, and a VH CDR3 having an amino acid sequence of SEQ ID NOs:3169, 3170, and 3171, respectively, and (ii) a VL comprising a VL CDR1, VL CDR2, and VL CDR3 having an amino acid sequence of SEQ ID NOs:3172, 3173, and 3174, respectively. In one aspect, provided herein is an antibody that binds CD4, comprising: (i) a VH comprising a VH CDR1, a VH CDR2, and a VH CDR3 having an amino acid sequence of SEQ ID NOs:3175, 3176, and 3177, respectively, and (ii) a VL comprising a VL CDR1, VL CDR2, and VL CDR3 having an amino acid sequence of SEQ ID NOs:3178, 3179, and 3180, respectively. In one aspect, provided herein is an antibody that binds CD4, comprising: (i) a VH comprising a VH CDR1, a VH CDR2, and a VH CDR3 having an amino acid sequence of SEQ ID NOs:3181, 3182, and 3183, respectively, and (ii) a VL comprising a VL CDR1, VL CDR2, and VL CDR3 having an amino acid sequence of SEQ ID NOs:3184, 3185, and 3186, respectively. In one aspect, provided herein is an antibody that binds CD4, comprising: (i) a VH comprising a VH CDR1, a VH CDR2, and a VH CDR3 having an amino acid sequence of SEQ ID NOs:3187, 3188, and 3189, respectively, and (ii) a VL comprising a VL CDR1, VL CDR2, and VL CDR3 having an amino acid sequence of SEQ ID NOs:3190, 3191, and 3192, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:3193; and (ii) a VL comprising a VL CDR1, a VL CDR2, and a VL CDR3 having an amino acid sequence of a VL CDR1, a VL CDR2, and a VL CDR3, respectively, of SEQ ID NO:3194. In one aspect, provided herein is an antibody that binds CD4, comprising a VH having an amino acid sequence of SEQ ID NO:3193. In one aspect, provided herein is an antibody that binds CD4, comprising a VL having an amino acid sequence of SEQ ID NO:3194. In one aspect, provided herein is an antibody that binds CD4, comprising a VH having an amino acid sequence of SEQ ID NO:3193, and a VL having an amino acid sequence of SEQ ID NO:3194. In one aspect, provided herein is an antibody that binds CD4, comprising a VH having an amino acid sequence having at least 95% identity to an amino acid sequence of SEQ ID NO:3193. In one aspect, provided herein is an antibody that binds CD4, comprising a VL having an amino acid sequence having at least 95% identity to an amino acid sequence of SEQ ID NO:3194. In one aspect, provided herein is an antibody that binds CD4, comprising a VH having an amino acid sequence having at least 95% identity to an amino acid sequence of SEQ ID NO:3193, and a VL having an amino acid sequence having at least 95% identity to an amino acid sequence of SEQ ID NO:3194.

In one aspect, provided herein is an antibody that binds CD4, comprising: (i) a VH comprising a VH CDR1, a VH CDR2, and a VH CDR3 having an amino acid sequence of SEQ ID NOs:3197, 3198, and 3199, respectively, and (ii) a VL comprising a VL CDR1, VL CDR2, and VL CDR3 having an amino acid sequence of SEQ ID NOs:3200, 3201, and 3202, respectively. In one aspect, provided herein is an antibody that binds CD4, comprising: (i) a VH comprising a VH CDR1, a VH CDR2, and a VH CDR3 having an amino acid sequence of SEQ ID NOs:3203, 3204, and 3205, respectively, and (ii) a VL comprising a VL CDR1, VL CDR2, and VL CDR3 having an amino acid sequence of SEQ ID NOs:3206, 3207, and 3208, respectively. In one aspect, provided herein is an antibody that binds CD4, comprising: (i) a VH comprising a VH CDR1, a VH CDR2, and a VH CDR3 having an amino acid sequence of SEQ ID NOs:3209, 3210, and 3211, respectively, and (ii) a VL comprising a VL CDR1, VL CDR2, and VL CDR3 having an amino acid sequence of SEQ ID NOs:3212, 3213, and 3214, respectively. In one aspect, provided herein is an antibody that binds CD4, comprising: (i) a VH comprising a VH CDR1, a VH CDR2, and a VH CDR3 having an amino acid sequence of SEQ ID NOs:3215, 3216, and 3217, respectively, and (ii) a VL comprising a VL CDR1, VL CDR2, and VL CDR3 having an amino acid sequence of SEQ ID NOs:3218, 3219, and 3220, respectively. In one aspect, provided herein is an antibody that binds CD4, comprising: (i) a VH comprising a VH CDR1, a VH CDR2, and a VH CDR3 having an amino acid sequence of SEQ ID NOs:3221, 3222, and 3223, respectively, and (ii) a VL comprising a VL CDR1, VL CDR2, and VL CDR3 having an amino acid sequence of SEQ ID NOs:3224, 3225, and 3226, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:3227; and (ii) a VL comprising a VL CDR1, a VL CDR2, and a VL CDR3 having an amino acid sequence of a VL CDR1, a VL CDR2, and a VL CDR3, respectively, of SEQ ID NO:3228. In one aspect, provided herein is an antibody that binds CD4, comprising a VH having an amino acid sequence of SEQ ID NO:3227. In one aspect, provided herein is an antibody that binds CD4, comprising a VL having an amino acid sequence of SEQ ID NO:3228. In one aspect, provided herein is an antibody that binds CD4, comprising a VH having an amino acid sequence of SEQ ID NO:3227, and a VL having an amino acid sequence of SEQ ID NO:3228. In one aspect, provided herein is an antibody that binds CD4, comprising a VH having an amino acid sequence having at least 95% identity to an amino acid sequence of SEQ ID NO:3227. In one aspect, provided herein is an antibody that binds CD4, comprising a VL having an amino acid sequence having at least 95% identity to an amino acid sequence of SEQ ID NO:3228. In one aspect, provided herein is an antibody that binds CD4, comprising a VH having an amino acid sequence having at least 95% identity to an amino acid sequence of SEQ ID NO:3227, and a VL having an amino acid sequence having at least 95% identity to an amino acid sequence of SEQ ID NO:3228.

In one aspect, provided herein is an antibody that binds CD4, comprising: (i) a VH comprising a VH CDR1, a VH CDR2, and a VH CDR3 having an amino acid sequence of SEQ ID NOs:3231, 3232, and 3233, respectively, and (ii) a VL comprising a VL CDR1, VL CDR2, and VL CDR3 having an amino acid sequence of SEQ ID NOs:3234, 3235, and 3236, respectively. In one aspect, provided herein is an antibody that binds CD4, comprising: (i) a VH comprising a VH CDR1, a VH CDR2, and a VH CDR3 having an amino acid sequence of SEQ ID NOs:3237, 3238, and 3239, respectively, and (ii) a VL comprising a VL CDR1, VL CDR2, and VL CDR3 having an amino acid sequence of SEQ ID NOs:3240, 3241, and 3242, respectively. In one aspect, provided herein is an antibody that binds CD4, comprising: (i) a VH comprising a VH CDR1, a VH CDR2, and a VH CDR3 having an amino acid sequence of SEQ ID NOs:3243, 3244, and 3245, respectively, and (ii) a VL comprising a VL CDR1, VL CDR2, and VL CDR3 having an amino acid sequence of SEQ ID NOs:3246, 3247, and 3248, respectively. In one aspect, provided herein is an antibody that binds CD4, comprising: (i) a VH comprising a VH CDR1, a VH CDR2, and a VH CDR3 having an amino acid sequence of SEQ ID NOs:3249, 3250, and 3251, respectively, and (ii) a VL comprising a VL CDR1, VL CDR2, and VL CDR3 having an amino acid sequence of SEQ ID NOs:3252, 3253, and 3254, respectively. In one aspect, provided herein is an antibody that binds CD4, comprising: (i) a VH comprising a VH CDR1, a VH CDR2, and a VH CDR3 having an amino acid sequence of SEQ ID NOs:3255, 3256, and 3257, respectively, and (ii) a VL comprising a VL CDR1, VL CDR2, and VL CDR3 having an amino acid sequence of SEQ ID NOs:3258, 3259, and 3260, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:3261; and (ii) a VL comprising a VL CDR1, a VL CDR2, and a VL CDR3 having an amino acid sequence of a VL CDR1, a VL CDR2, and a VL CDR3, respectively, of SEQ ID NO:3262. In one aspect, provided herein is an antibody that binds CD4, comprising a VH having an amino acid sequence of SEQ ID NO:3261. In one aspect, provided herein is an antibody that binds CD4, comprising a VL having an amino acid sequence of SEQ ID NO:3262. In one aspect, provided herein is an antibody that binds CD4, comprising a VH having an amino acid sequence of SEQ ID NO:3261, and a VL having an amino acid sequence of SEQ ID NO:3262. In one aspect, provided herein is an antibody that binds CD4, comprising a VH having an amino acid sequence having at least 95% identity to an amino acid sequence of SEQ ID NO:3261. In one aspect, provided herein is an antibody that binds CD4, comprising a VL having an amino acid sequence having at least 95% identity to an amino acid sequence of SEQ ID NO:3262. In one aspect, provided herein is an antibody that binds CD4, comprising a VH having an amino acid sequence having at least 95% identity to an amino acid sequence of SEQ ID NO:3261, and a VL having an amino acid sequence having at least 95% identity to an amino acid sequence of SEQ ID NO:3262.

In one aspect, provided herein is an antibody that binds CD4, comprising: (i) a VH comprising a VH CDR1, a VH CDR2, and a VH CDR3 having an amino acid sequence of SEQ ID NOs:3265, 3266, and 3267, respectively, and (ii) a VL comprising a VL CDR1, VL CDR2, and VL CDR3 having an amino acid sequence of SEQ ID NOs:3268, 3269, and 3270, respectively. In one aspect, provided herein is an antibody that binds CD4, comprising: (i) a VH comprising a VH CDR1, a VH CDR2, and a VH CDR3 having an amino acid sequence of SEQ ID NOs:3271, 3272, and 3273, respectively, and (ii) a VL comprising a VL CDR1, VL CDR2, and VL CDR3 having an amino acid sequence of SEQ ID NOs:3274, 3275, and 3276, respectively. In one aspect, provided herein is an antibody that binds CD4, comprising: (i) a VH comprising a VH CDR1, a VH CDR2, and a VH CDR3 having an amino acid sequence of SEQ ID NOs:3277, 3278, and 3279, respectively, and (ii) a VL comprising a VL CDR1, VL CDR2, and VL CDR3 having an amino acid sequence of SEQ ID NOs:3280, 3281, and 3282, respectively. In one aspect, provided herein is an antibody that binds CD4, comprising: (i) a VH comprising a VH CDR1, a VH CDR2, and a VH CDR3 having an amino acid sequence of SEQ ID NOs:3283, 3284, and 3285, respectively, and (ii) a VL comprising a VL CDR1, VL CDR2, and VL CDR3 having an amino acid sequence of SEQ ID NOs:3286, 3287, and 3288, respectively. In one aspect, provided herein is an antibody that binds CD4, comprising: (i) a VH comprising a VH CDR1, a VH CDR2, and a VH CDR3 having an amino acid sequence of SEQ ID NOs:3289, 3290, and 3291, respectively, and (ii) a VL comprising a VL CDR1, VL CDR2, and VL CDR3 having an amino acid sequence of SEQ ID NOs:3292, 3293, and 3294, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:3295; and (ii) a VL comprising a VL CDR1, a VL CDR2, and a VL CDR3 having an amino acid sequence of a VL CDR1, a VL CDR2, and a VL CDR3, respectively, of SEQ ID NO:3296. In one aspect, provided herein is an antibody that binds CD4, comprising a VH having an amino acid sequence of SEQ ID NO:3295. In one aspect, provided herein is an antibody that binds CD4, comprising a VL having an amino acid sequence of SEQ ID NO:3296. In one aspect, provided herein is an antibody that binds CD4, comprising a VH having an amino acid sequence of SEQ ID NO:3295, and a VL having an amino acid sequence of SEQ ID NO:3296. In one aspect, provided herein is an antibody that binds CD4, comprising a heavy chain having an amino acid sequence of SEQ ID NO:3297. In one aspect, provided herein is an antibody that binds CD4, comprising a light chain having an amino acid sequence of SEQ ID NO:3298. In one aspect, provided herein is an antibody that binds CD4, comprising a heavy chain having an amino acid sequence of SEQ ID NO:3297, and a light chain having an amino acid sequence of SEQ ID NO:3298. In one aspect, provided herein is an antibody that binds CD4, comprising a VH having an amino acid sequence having at least 95% identity to an amino acid sequence of SEQ ID NO:3295. In one aspect, provided herein is an antibody that binds CD4, comprising a VL having an amino acid sequence having at least 95% identity to an amino acid sequence of SEQ ID NO:3296. In one aspect, provided herein is an antibody that binds CD4, comprising a VH having an amino acid sequence having at least 95% identity to an amino acid sequence of SEQ ID NO:3295, and a VL having an amino acid sequence having at least 95% identity to an amino acid sequence of SEQ ID NO:3296. In one aspect, provided herein is an antibody that binds CD4, comprising a heavy chain having an amino acid sequence having at least 95% identity to an amino acid sequence of SEQ ID NO:3297. In one aspect, provided herein is an antibody that binds CD4, comprising a light chain having an amino acid sequence having at least 95% identity to an amino acid sequence of SEQ ID NO:3298. In one aspect, provided herein is an antibody that binds CD4, comprising a heavy chain having an amino acid sequence having at least 95% identity to an amino acid sequence of SEQ ID NO:3297, and a light chain having an amino acid sequence having at least 95% identity to an amino acid sequence of SEQ ID NO:3298.

In one aspect, provided herein is an antibody that binds CD4, comprising: (i) a VH comprising a VH CDR1, a VH CDR2, and a VH CDR3 having an amino acid sequence of SEQ ID NOs:3299, 3300, and 3301, respectively, and (ii) a VL comprising a VL CDR1, VL CDR2, and VL CDR3 having an amino acid sequence of SEQ ID NOs:3302, 3303, and 3304, respectively. In one aspect, provided herein is an antibody that binds CD4, comprising: (i) a VH comprising a VH CDR1, a VH CDR2, and a VH CDR3 having an amino acid sequence of SEQ ID NOs:3305, 3306, and 3307, respectively, and (ii) a VL comprising a VL CDR1, VL CDR2, and VL CDR3 having an amino acid sequence of SEQ ID NOs:3308, 3309, and 3310, respectively. In one aspect, provided herein is an antibody that binds CD4, comprising: (i) a VH comprising a VH CDR1, a VH CDR2, and a VH CDR3 having an amino acid sequence of SEQ ID NOs:3311, 3312, and 3313, respectively, and (ii) a VL comprising a VL CDR1, VL CDR2, and VL CDR3 having an amino acid sequence of SEQ ID NOs:3314, 3315, and 3316, respectively. In one aspect, provided herein is an antibody that binds CD4, comprising: (i) a VH comprising a VH CDR1, a VH CDR2, and a VH CDR3 having an amino acid sequence of SEQ ID NOs:3317, 3318, and 3319, respectively, and (ii) a VL comprising a VL CDR1, VL CDR2, and VL CDR3 having an amino acid sequence of SEQ ID NOs:3320, 3321, and 3322, respectively. In one aspect, provided herein is an antibody that binds CD4, comprising: (i) a VH comprising a VH CDR1, a VH CDR2, and a VH CDR3 having an amino acid sequence of SEQ ID NOs:3323, 3324, and 3325, respectively, and (ii) a VL comprising a VL CDR1, VL CDR2, and VL CDR3 having an amino acid sequence of SEQ ID NOs:3326, 3327, and 3328, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:3329; and (ii) a VL comprising a VL CDR1, a VL CDR2, and a VL CDR3 having an amino acid sequence of a VL CDR1, a VL CDR2, and a VL CDR3, respectively, of SEQ ID NO:3330. In one aspect, provided herein is an antibody that binds CD4, comprising a VH having an amino acid sequence of SEQ ID NO:3329. In one aspect, provided herein is an antibody that binds CD4, comprising a VL having an amino acid sequence of SEQ ID NO:3330. In one aspect, provided herein is an antibody that binds CD4, comprising a VH having an amino acid sequence of SEQ ID NO:3329, and a VL having an amino acid sequence of SEQ ID NO:3330. In one aspect, provided herein is an antibody that binds CD4, comprising a VH having an amino acid sequence having at least 95% identity to an amino acid sequence of SEQ ID NO:3329. In one aspect, provided herein is an antibody that binds CD4, comprising a VL having an amino acid sequence having at least 95% identity to an amino acid sequence of SEQ ID NO:3330. In one aspect, provided herein is an antibody that binds CD4, comprising a VH having an amino acid sequence having at least 95% identity to an amino acid sequence of SEQ ID NO:3329, and a VL having an amino acid sequence having at least 95% identity to an amino acid sequence of SEQ ID NO:3330.

In one aspect, provided herein is an antibody that binds CD4, comprising: (i) a VH comprising a VH CDR1, a VH CDR2, and a VH CDR3 having an amino acid sequence of SEQ ID NOs:3333, 3334, and 3335, respectively, and (ii) a VL comprising a VL CDR1, VL CDR2, and VL CDR3 having an amino acid sequence of SEQ ID NOs:3336, 3337, and 3338, respectively. In one aspect, provided herein is an antibody that binds CD4, comprising: (i) a VH comprising a VH CDR1, a VH CDR2, and a VH CDR3 having an amino acid sequence of SEQ ID NOs:3339, 3340, and 3341, respectively, and (ii) a VL comprising a VL CDR1, VL CDR2, and VL CDR3 having an amino acid sequence of SEQ ID NOs:3342, 3343, and 3344, respectively. In one aspect, provided herein is an antibody that binds CD4, comprising: (i) a VH comprising a VH CDR1, a VH CDR2, and a VH CDR3 having an amino acid sequence of SEQ ID NOs:3345, 3346, and 3347, respectively, and (ii) a VL comprising a VL CDR1, VL CDR2, and VL CDR3 having an amino acid sequence of SEQ ID NOs:3348, 3349, and 3350, respectively. In one aspect, provided herein is an antibody that binds CD4, comprising: (i) a VH comprising a VH CDR1, a VH CDR2, and a VH CDR3 having an amino acid sequence of SEQ ID NOs:3351, 3352, and 3353, respectively, and (ii) a VL comprising a VL CDR1, VL CDR2, and VL CDR3 having an amino acid sequence of SEQ ID NOs:3354, 3355, and 3356, respectively. In one aspect, provided herein is an antibody that binds CD4, comprising: (i) a VH comprising a VH CDR1, a VH CDR2, and a VH CDR3 having an amino acid sequence of SEQ ID NOs:3357, 3358, and 3359, respectively, and (ii) a VL comprising a VL CDR1, VL CDR2, and VL CDR3 having an amino acid sequence of SEQ ID NOs:3360, 3361, and 3362, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:3363; and (ii) a VL comprising a VL CDR1, a VL CDR2, and a VL CDR3 having an amino acid sequence of a VL CDR1, a VL CDR2, and a VL CDR3, respectively, of SEQ ID NO:3364. In one aspect, provided herein is an antibody that binds CD4, comprising a VH having an amino acid sequence of SEQ ID NO:3363. In one aspect, provided herein is an antibody that binds CD4, comprising a VL having an amino acid sequence of SEQ ID NO:3364. In one aspect, provided herein is an antibody that binds CD4, comprising a VH having an amino acid sequence of SEQ ID NO:3363, and a VL having an amino acid sequence of SEQ ID NO:3364. In one aspect, provided herein is an antibody that binds CD4, comprising a VH having an amino acid sequence having at least 95% identity to an amino acid sequence of SEQ ID NO:3363. In one aspect, provided herein is an antibody that binds CD4, comprising a VL having an amino acid sequence having at least 95% identity to an amino acid sequence of SEQ ID NO:3364. In one aspect, provided herein is an antibody that binds CD4, comprising a VH having an amino acid sequence having at least 95% identity to an amino acid sequence of SEQ ID NO:3363, and a VL having an amino acid sequence having at least 95% identity to an amino acid sequence of SEQ ID NO:3364.

In one aspect, provided herein is an antibody that binds CD4, comprising: (i) a VH comprising a VH CDR1, a VH CDR2, and a VH CDR3 having an amino acid sequence of SEQ ID NOs:3367, 3368, and 3369, respectively, and (ii) a VL comprising a VL CDR1, VL CDR2, and VL CDR3 having an amino acid sequence of SEQ ID NOs:3370, 3371, and 3372, respectively. In one aspect, provided herein is an antibody that binds CD4, comprising: (i) a VH comprising a VH CDR1, a VH CDR2, and a VH CDR3 having an amino acid sequence of SEQ ID NOs:3373, 3374, and 3375, respectively, and (ii) a VL comprising a VL CDR1, VL CDR2, and VL CDR3 having an amino acid sequence of SEQ ID NOs:3376, 3377, and 3378, respectively. In one aspect, provided herein is an antibody that binds CD4, comprising: (i) a VH comprising a VH CDR1, a VH CDR2, and a VH CDR3 having an amino acid sequence of SEQ ID NOs:3379, 3380, and 3381, respectively, and (ii) a VL comprising a VL CDR1, VL CDR2, and VL CDR3 having an amino acid sequence of SEQ ID NOs:3382, 3383, and 3384, respectively. In one aspect, provided herein is an antibody that binds CD4, comprising: (i) a VH comprising a VH CDR1, a VH CDR2, and a VH CDR3 having an amino acid sequence of SEQ ID NOs:3385, 3386, and 3387, respectively, and (ii) a VL comprising a VL CDR1, VL CDR2, and VL CDR3 having an amino acid sequence of SEQ ID NOs:3388, 3389, and 3390, respectively. In one aspect, provided herein is an antibody that binds CD4, comprising: (i) a VH comprising a VH CDR1, a VH CDR2, and a VH CDR3 having an amino acid sequence of SEQ ID NOs:3391, 3392, and 3393, respectively, and (ii) a VL comprising a VL CDR1, VL CDR2, and VL CDR3 having an amino acid sequence of SEQ ID NOs:3394, 3395, and 3396, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:3397; and (ii) a VL comprising a VL CDR1, a VL CDR2, and a VL CDR3 having an amino acid sequence of a VL CDR1, a VL CDR2, and a VL CDR3, respectively, of SEQ ID NO:3398. In one aspect, provided herein is an antibody that binds CD4, comprising a VH having an amino acid sequence of SEQ ID NO:3397. In one aspect, provided herein is an antibody that binds CD4, comprising a VL having an amino acid sequence of SEQ ID NO:3398. In one aspect, provided herein is an antibody that binds CD4, comprising a VH having an amino acid sequence of SEQ ID NO:3397, and a VL having an amino acid sequence of SEQ ID NO:3398. In one aspect, provided herein is an antibody that binds CD4, comprising a heavy chain having an amino acid sequence of SEQ ID NO:3399. In one aspect, provided herein is an antibody that binds CD4, comprising a light chain having an amino acid sequence of SEQ ID NO:3400. In one aspect, provided herein is an antibody that binds CD4, comprising a heavy chain having an amino acid sequence of SEQ ID NO:3399, and a light chain having an amino acid sequence of SEQ ID NO:3400. In one aspect, provided herein is an antibody that binds CD4, comprising a VH having an amino acid sequence having at least 95% identity to an amino acid sequence of SEQ ID NO:3397. In one aspect, provided herein is an antibody that binds CD4, comprising a VL having an amino acid sequence having at least 95% identity to an amino acid sequence of SEQ ID NO:3398. In one aspect, provided herein is an antibody that binds CD4, comprising a VH having an amino acid sequence having at least 95% identity to an amino acid sequence of SEQ ID NO:3397, and a VL having an amino acid sequence having at least 95% identity to an amino acid sequence of SEQ ID NO:3398. In one aspect, provided herein is an antibody that binds CD4, comprising a heavy chain having an amino acid sequence having at least 95% identity to an amino acid sequence of SEQ ID NO:3399. In one aspect, provided herein is an antibody that binds CD4, comprising a light chain having an amino acid sequence having at least 95% identity to an amino acid sequence of SEQ ID NO:3400. In one aspect, provided herein is an antibody that binds CD4, comprising a heavy chain having an amino acid sequence having at least 95% identity to an amino acid sequence of SEQ ID NO:3399, and a light chain having an amino acid sequence having at least 95% identity to an amino acid sequence of SEQ ID NO:3400.

In one aspect, provided herein is an antibody that binds CD4, comprising: (i) a VH comprising a VH CDR1, a VH CDR2, and a VH CDR3 having an amino acid sequence of SEQ ID NOs:3401, 3402, and 3403, respectively, and (ii) a VL comprising a VL CDR1, VL CDR2, and VL CDR3 having an amino acid sequence of SEQ ID NOs:3404, 3405, and 3406, respectively. In one aspect, provided herein is an antibody that binds CD4, comprising: (i) a VH comprising a VH CDR1, a VH CDR2, and a VH CDR3 having an amino acid sequence of SEQ ID NOs:3407, 3408, and 3409, respectively, and (ii) a VL comprising a VL CDR1, VL CDR2, and VL CDR3 having an amino acid sequence of SEQ ID NOs:3410, 3411, and 3412, respectively. In one aspect, provided herein is an antibody that binds CD4, comprising: (i) a VH comprising a VH CDR1, a VH CDR2, and a VH CDR3 having an amino acid sequence of SEQ ID NOs:3413, 3414, and 3415, respectively, and (ii) a VL comprising a VL CDR1, VL CDR2, and VL CDR3 having an amino acid sequence of SEQ ID NOs:3416, 3417, and 3418, respectively. In one aspect, provided herein is an antibody that binds CD4, comprising: (i) a VH comprising a VH CDR1, a VH CDR2, and a VH CDR3 having an amino acid sequence of SEQ ID NOs:3419, 3420, and 3421, respectively, and (ii) a VL comprising a VL CDR1, VL CDR2, and VL CDR3 having an amino acid sequence of SEQ ID NOs:3422, 3423, and 3424, respectively. In one aspect, provided herein is an antibody that binds CD4, comprising: (i) a VH comprising a VH CDR1, a VH CDR2, and a VH CDR3 having an amino acid sequence of SEQ ID NOs:3425, 3426, and 3427, respectively, and (ii) a VL comprising a VL CDR1, VL CDR2, and VL CDR3 having an amino acid sequence of SEQ ID NOs:3428, 3429, and 3430, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:3431; and (ii) a VL comprising a VL CDR1, a VL CDR2, and a VL CDR3 having an amino acid sequence of a VL CDR1, a VL CDR2, and a VL CDR3, respectively, of SEQ ID NO:3432. In one aspect, provided herein is an antibody that binds CD4, comprising a VH having an amino acid sequence of SEQ ID NO:3431. In one aspect, provided herein is an antibody that binds CD4, comprising a VL having an amino acid sequence of SEQ ID NO:3432. In one aspect, provided herein is an antibody that binds CD4, comprising a VH having an amino acid sequence of SEQ ID NO:3431, and a VL having an amino acid sequence of SEQ ID NO:3432. In one aspect, provided herein is an antibody that binds CD4, comprising a VH having an amino acid sequence having at least 95% identity to an amino acid sequence of SEQ ID NO:3431. In one aspect, provided herein is an antibody that binds CD4, comprising a VL having an amino acid sequence having at least 95% identity to an amino acid sequence of SEQ ID NO:3432. In one aspect, provided herein is an antibody that binds CD4, comprising a VH having an amino acid sequence having at least 95% identity to an amino acid sequence of SEQ ID NO:3431, and a VL having an amino acid sequence having at least 95% identity to an amino acid sequence of SEQ ID NO:3432.

In one aspect, provided herein is an antibody that binds CD4, comprising: (i) a VH comprising a VH CDR1, a VH CDR2, and a VH CDR3 having an amino acid sequence of SEQ ID NOs:3435, 3436, and 3437, respectively, and (ii) a VL comprising a VL CDR1, VL CDR2, and VL CDR3 having an amino acid sequence of SEQ ID NOs:3438, 3439, and 3440, respectively. In one aspect, provided herein is an antibody that binds CD4, comprising: (i) a VH comprising a VH CDR1, a VH CDR2, and a VH CDR3 having an amino acid sequence of SEQ ID NOs:3441, 3442, and 3443, respectively, and (ii) a VL comprising a VL CDR1, VL CDR2, and VL CDR3 having an amino acid sequence of SEQ ID NOs:3444, 3445, and 3446, respectively. In one aspect, provided herein is an antibody that binds CD4, comprising: (i) a VH comprising a VH CDR1, a VH CDR2, and a VH CDR3 having an amino acid sequence of SEQ ID NOs:3447, 3448, and 3449, respectively, and (ii) a VL comprising a VL CDR1, VL CDR2, and VL CDR3 having an amino acid sequence of SEQ ID NOs:3450, 3451, and 3452, respectively. In one aspect, provided herein is an antibody that binds CD4, comprising: (i) a VH comprising a VH CDR1, a VH CDR2, and a VH CDR3 having an amino acid sequence of SEQ ID NOs:3453, 3454, and 3455, respectively, and (ii) a VL comprising a VL CDR1, VL CDR2, and VL CDR3 having an amino acid sequence of SEQ ID NOs:3456, 3457, and 3458, respectively. In one aspect, provided herein is an antibody that binds CD4, comprising: (i) a VH comprising a VH CDR1, a VH CDR2, and a VH CDR3 having an amino acid sequence of SEQ ID NOs:3459, 3460, and 3461, respectively, and (ii) a VL comprising a VL CDR1, VL CDR2, and VL CDR3 having an amino acid sequence of SEQ ID NOs:3462, 3463, and 3464, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:3465; and (ii) a VL comprising a VL CDR1, a VL CDR2, and a VL CDR3 having an amino acid sequence of a VL CDR1, a VL CDR2, and a VL CDR3, respectively, of SEQ ID NO:3466. In one aspect, provided herein is an antibody that binds CD4, comprising a VH having an amino acid sequence of SEQ ID NO:3465. In one aspect, provided herein is an antibody that binds CD4, comprising a VL having an amino acid sequence of SEQ ID NO:3466. In one aspect, provided herein is an antibody that binds CD4, comprising a VH having an amino acid sequence of SEQ ID NO:3465, and a VL having an amino acid sequence of SEQ ID NO:3466. In one aspect, provided herein is an antibody that binds CD4, comprising a VH having an amino acid sequence having at least 95% identity to an amino acid sequence of SEQ ID NO:3465. In one aspect, provided herein is an antibody that binds CD4, comprising a VL having an amino acid sequence having at least 95% identity to an amino acid sequence of SEQ ID NO:3466. In one aspect, provided herein is an antibody that binds CD4, comprising a VH having an amino acid sequence having at least 95% identity to an amino acid sequence of SEQ ID NO:3465, and a VL having an amino acid sequence having at least 95% identity to an amino acid sequence of SEQ ID NO:3466.

In one aspect, provided herein is an antibody that binds CD4, comprising: (i) a VH comprising a VH CDR1, a VH CDR2, and a VH CDR3 having an amino acid sequence of SEQ ID NOs:3469, 3470, and 3471, respectively, and (ii) a VL comprising a VL CDR1, VL CDR2, and VL CDR3 having an amino acid sequence of SEQ ID NOs:3472, 3473, and 3474, respectively. In one aspect, provided herein is an antibody that binds CD4, comprising: (i) a VH comprising a VH CDR1, a VH CDR2, and a VH CDR3 having an amino acid sequence of SEQ ID NOs:3475, 3476, and 3477, respectively, and (ii) a VL comprising a VL CDR1, VL CDR2, and VL CDR3 having an amino acid sequence of SEQ ID NOs:3478, 3479, and 3480, respectively. In one aspect, provided herein is an antibody that binds CD4, comprising: (i) a VH comprising a VH CDR1, a VH CDR2, and a VH CDR3 having an amino acid sequence of SEQ ID NOs:3481, 3482, and 3483, respectively, and (ii) a VL comprising a VL CDR1, VL CDR2, and VL CDR3 having an amino acid sequence of SEQ ID NOs:3484, 3485, and 3486, respectively. In one aspect, provided herein is an antibody that binds CD4, comprising: (i) a VH comprising a VH CDR1, a VH CDR2, and a VH CDR3 having an amino acid sequence of SEQ ID NOs:3487, 3488, and 3489, respectively, and (ii) a VL comprising a VL CDR1, VL CDR2, and VL CDR3 having an amino acid sequence of SEQ ID NOs:3490, 3491, and 3492, respectively. In one aspect, provided herein is an antibody that binds CD4, comprising: (i) a VH comprising a VH CDR1, a VH CDR2, and a VH CDR3 having an amino acid sequence of SEQ ID NOs:3493, 3494, and 3495, respectively, and (ii) a VL comprising a VL CDR1, VL CDR2, and VL CDR3 having an amino acid sequence of SEQ ID NOs:3496, 3497, and 3498, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:3499; and (ii) a VL comprising a VL CDR1, a VL CDR2, and a VL CDR3 having an amino acid sequence of a VL CDR1, a VL CDR2, and a VL CDR3, respectively, of SEQ ID NO:3500. In one aspect, provided herein is an antibody that binds CD4, comprising a VH having an amino acid sequence of SEQ ID NO:3499. In one aspect, provided herein is an antibody that binds CD4, comprising a VL having an amino acid sequence of SEQ ID NO:3500. In one aspect, provided herein is an antibody that binds CD4, comprising a VH having an amino acid sequence of SEQ ID NO:3499, and a VL having an amino acid sequence of SEQ ID NO:3500. In one aspect, provided herein is an antibody that binds CD4, comprising a VH having an amino acid sequence having at least 95% identity to an amino acid sequence of SEQ ID NO:3499. In one aspect, provided herein is an antibody that binds CD4, comprising a VL having an amino acid sequence having at least 95% identity to an amino acid sequence of SEQ ID NO:3500. In one aspect, provided herein is an antibody that binds CD4, comprising a VH having an amino acid sequence having at least 95% identity to an amino acid sequence of SEQ ID NO:3499, and a VL having an amino acid sequence having at least 95% identity to an amino acid sequence of SEQ ID NO:3500.

In one aspect, provided herein is an antibody that binds CD4, comprising: (i) a VH comprising a VH CDR1, a VH CDR2, and a VH CDR3 having an amino acid sequence of SEQ ID NOs:3503, 3504, and 3505, respectively, and (ii) a VL comprising a VL CDR1, VL CDR2, and VL CDR3 having an amino acid sequence of SEQ ID NOs:3506, 3507, and 3508, respectively. In one aspect, provided herein is an antibody that binds CD4, comprising: (i) a VH comprising a VH CDR1, a VH CDR2, and a VH CDR3 having an amino acid sequence of SEQ ID NOs:3509, 3510, and 3511, respectively, and (ii) a VL comprising a VL CDR1, VL CDR2, and VL CDR3 having an amino acid sequence of SEQ ID NOs:3512, 3513, and 3514, respectively. In one aspect, provided herein is an antibody that binds CD4, comprising: (i) a VH comprising a VH CDR1, a VH CDR2, and a VH CDR3 having an amino acid sequence of SEQ ID NOs:3515, 3516, and 3517, respectively, and (ii) a VL comprising a VL CDR1, VL CDR2, and VL CDR3 having an amino acid sequence of SEQ ID NOs:3518, 3519, and 3520, respectively. In one aspect, provided herein is an antibody that binds CD4, comprising: (i) a VH comprising a VH CDR1, a VH CDR2, and a VH CDR3 having an amino acid sequence of SEQ ID NOs:3521, 3522, and 3523, respectively, and (ii) a VL comprising a VL CDR1, VL CDR2, and VL CDR3 having an amino acid sequence of SEQ ID NOs:3524, 3525, and 3526, respectively. In one aspect, provided herein is an antibody that binds CD4, comprising: (i) a VH comprising a VH CDR1, a VH CDR2, and a VH CDR3 having an amino acid sequence of SEQ ID NOs:3527, 3528, and 3529, respectively, and (ii) a VL comprising a VL CDR1, VL CDR2, and VL CDR3 having an amino acid sequence of SEQ ID NOs:3530, 3531, and 3532, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:3533; and (ii) a VL comprising a VL CDR1, a VL CDR2, and a VL CDR3 having an amino acid sequence of a VL CDR1, a VL CDR2, and a VL CDR3, respectively, of SEQ ID NO:3534. In one aspect, provided herein is an antibody that binds CD4, comprising a VH having an amino acid sequence of SEQ ID NO:3533. In one aspect, provided herein is an antibody that binds CD4, comprising a VL having an amino acid sequence of SEQ ID NO:3534. In one aspect, provided herein is an antibody that binds CD4, comprising a VH having an amino acid sequence of SEQ ID NO:3533, and a VL having an amino acid sequence of SEQ ID NO:3534. In one aspect, provided herein is an antibody that binds CD4, comprising a VH having an amino acid sequence having at least 95% identity to an amino acid sequence of SEQ ID NO:3533. In one aspect, provided herein is an antibody that binds CD4, comprising a VL having an amino acid sequence having at least 95% identity to an amino acid sequence of SEQ ID NO:3534. In one aspect, provided herein is an antibody that binds CD4, comprising a VH having an amino acid sequence having at least 95% identity to an amino acid sequence of SEQ ID NO:3533, and a VL having an amino acid sequence having at least 95% identity to an amino acid sequence of SEQ ID NO:3534.

In one aspect, provided herein is an antibody that binds CD4, comprising: (i) a VH comprising a VH CDR1, a VH CDR2, and a VH CDR3 having an amino acid sequence of SEQ ID NOs:3537, 3538, and 3539, respectively, and (ii) a VL comprising a VL CDR1, VL CDR2, and VL CDR3 having an amino acid sequence of SEQ ID NOs:3540, 3541, and 3542, respectively. In one aspect, provided herein is an antibody that binds CD4, comprising: (i) a VH comprising a VH CDR1, a VH CDR2, and a VH CDR3 having an amino acid sequence of SEQ ID NOs:3543, 3544, and 3545, respectively, and (ii) a VL comprising a VL CDR1, VL CDR2, and VL CDR3 having an amino acid sequence of SEQ ID NOs:3546, 3547, and 3548, respectively. In one aspect, provided herein is an antibody that binds CD4, comprising: (i) a VH comprising a VH CDR1, a VH CDR2, and a VH CDR3 having an amino acid sequence of SEQ ID NOs:3549, 3550, and 3551, respectively, and (ii) a VL comprising a VL CDR1, VL CDR2, and VL CDR3 having an amino acid sequence of SEQ ID NOs:3552, 3553, and 3554, respectively. In one aspect, provided herein is an antibody that binds CD4, comprising: (i) a VH comprising a VH CDR1, a VH CDR2, and a VH CDR3 having an amino acid sequence of SEQ ID NOs:3555, 3556, and 3557, respectively, and (ii) a VL comprising a VL CDR1, VL CDR2, and VL CDR3 having an amino acid sequence of SEQ ID NOs:3558, 3559, and 3560, respectively. In one aspect, provided herein is an antibody that binds CD4, comprising: (i) a VH comprising a VH CDR1, a VH CDR2, and a VH CDR3 having an amino acid sequence of SEQ ID NOs:3561, 3562, and 3563, respectively, and (ii) a VL comprising a VL CDR1, VL CDR2, and VL CDR3 having an amino acid sequence of SEQ ID NOs:3564, 3565, and 3566, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:3567; and (ii) a VL comprising a VL CDR1, a VL CDR2, and a VL CDR3 having an amino acid sequence of a VL CDR1, a VL CDR2, and a VL CDR3, respectively, of SEQ ID NO:3568. In one aspect, provided herein is an antibody that binds CD4, comprising a VH having an amino acid sequence of SEQ ID NO:3567. In one aspect, provided herein is an antibody that binds CD4, comprising a VL having an amino acid sequence of SEQ ID NO:3568. In one aspect, provided herein is an antibody that binds CD4, comprising a VH having an amino acid sequence of SEQ ID NO:3567, and a VL having an amino acid sequence of SEQ ID NO:3568. In one aspect, provided herein is an antibody that binds CD4, comprising a VH having an amino acid sequence having at least 95% identity to an amino acid sequence of SEQ ID NO:3567. In one aspect, provided herein is an antibody that binds CD4, comprising a VL having an amino acid sequence having at least 95% identity to an amino acid sequence of SEQ ID NO:3568. In one aspect, provided herein is an antibody that binds CD4, comprising a VH having an amino acid sequence having at least 95% identity to an amino acid sequence of SEQ ID NO:3567, and a VL having an amino acid sequence having at least 95% identity to an amino acid sequence of SEQ ID NO:3568.

In one aspect, provided herein is an antibody that binds CD4, comprising: (i) a VH comprising a VH CDR1, a VH CDR2, and a VH CDR3 having an amino acid sequence of SEQ ID NOs:3571, 3572, and 3573, respectively, and (ii) a VL comprising a VL CDR1, VL CDR2, and VL CDR3 having an amino acid sequence of SEQ ID NOs:3574, 3575, and 3576, respectively. In one aspect, provided herein is an antibody that binds CD4, comprising: (i) a VH comprising a VH CDR1, a VH CDR2, and a VH CDR3 having an amino acid sequence of SEQ ID NOs:3577, 3578, and 3579, respectively, and (ii) a VL comprising a VL CDR1, VL CDR2, and VL CDR3 having an amino acid sequence of SEQ ID NOs:3580, 3581, and 3582, respectively. In one aspect, provided herein is an antibody that binds CD4, comprising: (i) a VH comprising a VH CDR1, a VH CDR2, and a VH CDR3 having an amino acid sequence of SEQ ID NOs:3583, 3584, and 3585, respectively, and (ii) a VL comprising a VL CDR1, VL CDR2, and VL CDR3 having an amino acid sequence of SEQ ID NOs:3586, 3587, and 3588, respectively. In one aspect, provided herein is an antibody that binds CD4, comprising: (i) a VH comprising a VH CDR1, a VH CDR2, and a VH CDR3 having an amino acid sequence of SEQ ID NOs:3589, 3590, and 3591, respectively, and (ii) a VL comprising a VL CDR1, VL CDR2, and VL CDR3 having an amino acid sequence of SEQ ID NOs:3592, 3593, and 3594, respectively. In one aspect, provided herein is an antibody that binds CD4, comprising: (i) a VH comprising a VH CDR1, a VH CDR2, and a VH CDR3 having an amino acid sequence of SEQ ID NOs:3595, 3596, and 3597, respectively, and (ii) a VL comprising a VL CDR1, VL CDR2, and VL CDR3 having an amino acid sequence of SEQ ID NOs:3598, 3599, and 3600, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:3601; and (ii) a VL comprising a VL CDR1, a VL CDR2, and a VL CDR3 having an amino acid sequence of a VL CDR1, a VL CDR2, and a VL CDR3, respectively, of SEQ ID NO:3602. In one aspect, provided herein is an antibody that binds CD4, comprising a VH having an amino acid sequence of SEQ ID NO:3601. In one aspect, provided herein is an antibody that binds CD4, comprising a VL having an amino acid sequence of SEQ ID NO:3602. In one aspect, provided herein is an antibody that binds CD4, comprising a VH having an amino acid sequence of SEQ ID NO:3601, and a VL having an amino acid sequence of SEQ ID NO:3602. In one aspect, provided herein is an antibody that binds CD4, comprising a VH having an amino acid sequence having at least 95% identity to an amino acid sequence of SEQ ID NO:3601. In one aspect, provided herein is an antibody that binds CD4, comprising a VL having an amino acid sequence having at least 95% identity to an amino acid sequence of SEQ ID NO:3602. In one aspect, provided herein is an antibody that binds CD4, comprising a VH having an amino acid sequence having at least 95% identity to an amino acid sequence of SEQ ID NO:3601, and a VL having an amino acid sequence having at least 95% identity to an amino acid sequence of SEQ ID NO:3602.

In one aspect, provided herein is an antibody that binds CD4, comprising: (i) a VH comprising a VH CDR1, a VH CDR2, and a VH CDR3 having an amino acid sequence of SEQ ID NOs:3605, 3606, and 3607, respectively, and (ii) a VL comprising a VL CDR1, VL CDR2, and VL CDR3 having an amino acid sequence of SEQ ID NOs:3608, 3609, and 3610, respectively. In one aspect, provided herein is an antibody that binds CD4, comprising: (i) a VH comprising a VH CDR1, a VH CDR2, and a VH CDR3 having an amino acid sequence of SEQ ID NOs:3611, 3612, and 3613, respectively, and (ii) a VL comprising a VL CDR1, VL CDR2, and VL CDR3 having an amino acid sequence of SEQ ID NOs:3614, 3615, and 3616, respectively. In one aspect, provided herein is an antibody that binds CD4, comprising: (i) a VH comprising a VH CDR1, a VH CDR2, and a VH CDR3 having an amino acid sequence of SEQ ID NOs:3617, 3618, and 3619, respectively, and (ii) a VL comprising a VL CDR1, VL CDR2, and VL CDR3 having an amino acid sequence of SEQ ID NOs:3620, 3621, and 3622, respectively. In one aspect, provided herein is an antibody that binds CD4, comprising: (i) a VH comprising a VH CDR1, a VH CDR2, and a VH CDR3 having an amino acid sequence of SEQ ID NOs:3623, 3624, and 3625, respectively, and (ii) a VL comprising a VL CDR1, VL CDR2, and VL CDR3 having an amino acid sequence of SEQ ID NOs:3626, 3627, and 3628, respectively. In one aspect, provided herein is an antibody that binds CD4, comprising: (i) a VH comprising a VH CDR1, a VH CDR2, and a VH CDR3 having an amino acid sequence of SEQ ID NOs:3629, 3630, and 3631, respectively, and (ii) a VL comprising a VL CDR1, VL CDR2, and VL CDR3 having an amino acid sequence of SEQ ID NOs:3632, 3633, and 3634, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:3635; and (ii) a VL comprising a VL CDR1, a VL CDR2, and a VL CDR3 having an amino acid sequence of a VL CDR1, a VL CDR2, and a VL CDR3, respectively, of SEQ ID NO:3636. In one aspect, provided herein is an antibody that binds CD4, comprising a VH having an amino acid sequence of SEQ ID NO:3635. In one aspect, provided herein is an antibody that binds CD4, comprising a VL having an amino acid sequence of SEQ ID NO:3636. In one aspect, provided herein is an antibody that binds CD4, comprising a VH having an amino acid sequence of SEQ ID NO:3635, and a VL having an amino acid sequence of SEQ ID NO:3636. In one aspect, provided herein is an antibody that binds CD4, comprising a VH having an amino acid sequence having at least 95% identity to an amino acid sequence of SEQ ID NO:3635. In one aspect, provided herein is an antibody that binds CD4, comprising a VL having an amino acid sequence having at least 95% identity to an amino acid sequence of SEQ ID NO:3636. In one aspect, provided herein is an antibody that binds CD4, comprising a VH having an amino acid sequence having at least 95% identity to an amino acid sequence of SEQ ID NO:3635, and a VL having an amino acid sequence having at least 95% identity to an amino acid sequence of SEQ ID NO:3636.

In one aspect, provided herein is an antibody that binds CD4, comprising: (i) a VH comprising a VH CDR1, a VH CDR2, and a VH CDR3 having an amino acid sequence of SEQ ID NOs:3639, 3640, and 3641, respectively, and (ii) a VL comprising a VL CDR1, VL CDR2, and VL CDR3 having an amino acid sequence of SEQ ID NOs:3642, 3643, and 3644, respectively. In one aspect, provided herein is an antibody that binds CD4, comprising: (i) a VH comprising a VH CDR1, a VH CDR2, and a VH CDR3 having an amino acid sequence of SEQ ID NOs:3645, 3646, and 3647, respectively, and (ii) a VL comprising a VL CDR1, VL CDR2, and VL CDR3 having an amino acid sequence of SEQ ID NOs:3648, 3649, and 3650, respectively. In one aspect, provided herein is an antibody that binds CD4, comprising: (i) a VH comprising a VH CDR1, a VH CDR2, and a VH CDR3 having an amino acid sequence of SEQ ID NOs:3651, 3652, and 3653, respectively, and (ii) a VL comprising a VL CDR1, VL CDR2, and VL CDR3 having an amino acid sequence of SEQ ID NOs:3654, 3655, and 3656, respectively. In one aspect, provided herein is an antibody that binds CD4, comprising: (i) a VH comprising a VH CDR1, a VH CDR2, and a VH CDR3 having an amino acid sequence of SEQ ID NOs:3657, 3658, and 3659, respectively, and (ii) a VL comprising a VL CDR1, VL CDR2, and VL CDR3 having an amino acid sequence of SEQ ID NOs:3660, 3661, and 3662, respectively. In one aspect, provided herein is an antibody that binds CD4, comprising: (i) a VH comprising a VH CDR1, a VH CDR2, and a VH CDR3 having an amino acid sequence of SEQ ID NOs:3663, 3664, and 3665, respectively, and (ii) a VL comprising a VL CDR1, VL CDR2, and VL CDR3 having an amino acid sequence of SEQ ID NOs:3666, 3667, and 3668, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:3669; and (ii) a VL comprising a VL CDR1, a VL CDR2, and a VL CDR3 having an amino acid sequence of a VL CDR1, a VL CDR2, and a VL CDR3, respectively, of SEQ ID NO:3670. In one aspect, provided herein is an antibody that binds CD4, comprising a VH having an amino acid sequence of SEQ ID NO:3669. In one aspect, provided herein is an antibody that binds CD4, comprising a VL having an amino acid sequence of SEQ ID NO:3670. In one aspect, provided herein is an antibody that binds CD4, comprising a VH having an amino acid sequence of SEQ ID NO:3669, and a VL having an amino acid sequence of SEQ ID NO:3670. In one aspect, provided herein is an antibody that binds CD4, comprising a VH having an amino acid sequence having at least 95% identity to an amino acid sequence of SEQ ID NO:3669. In one aspect, provided herein is an antibody that binds CD4, comprising a VL having an amino acid sequence having at least 95% identity to an amino acid sequence of SEQ ID NO:3670. In one aspect, provided herein is an antibody that binds CD4, comprising a VH having an amino acid sequence having at least 95% identity to an amino acid sequence of SEQ ID NO:3669, and a VL having an amino acid sequence having at least 95% identity to an amino acid sequence of SEQ ID NO:3670.

In one aspect, provided herein is an antibody that binds CD4, comprising: (i) a VH comprising a VH CDR1, a VH CDR2, and a VH CDR3 having an amino acid sequence of SEQ ID NOs:3673, 3674, and 3675, respectively, and (ii) a VL comprising a VL CDR1, VL CDR2, and VL CDR3 having an amino acid sequence of SEQ ID NOs:3676, 3677, and 3678, respectively. In one aspect, provided herein is an antibody that binds CD4, comprising: (i) a VH comprising a VH CDR1, a VH CDR2, and a VH CDR3 having an amino acid sequence of SEQ ID NOs:3679, 3680, and 3681, respectively, and (ii) a VL comprising a VL CDR1, VL CDR2, and VL CDR3 having an amino acid sequence of SEQ ID NOs:3682, 3683, and 3684, respectively. In one aspect, provided herein is an antibody that binds CD4, comprising: (i) a VH comprising a VH CDR1, a VH CDR2, and a VH CDR3 having an amino acid sequence of SEQ ID NOs:3685, 3686, and 3687, respectively, and (ii) a VL comprising a VL CDR1, VL CDR2, and VL CDR3 having an amino acid sequence of SEQ ID NOs:3688, 3689, and 3690, respectively. In one aspect, provided herein is an antibody that binds CD4, comprising: (i) a VH comprising a VH CDR1, a VH CDR2, and a VH CDR3 having an amino acid sequence of SEQ ID NOs:3691, 3692, and 3693, respectively, and (ii) a VL comprising a VL CDR1, VL CDR2, and VL CDR3 having an amino acid sequence of SEQ ID NOs:3694, 3695, and 3696, respectively. In one aspect, provided herein is an antibody that binds CD4, comprising: (i) a VH comprising a VH CDR1, a VH CDR2, and a VH CDR3 having an amino acid sequence of SEQ ID NOs:3697, 3698, and 3699, respectively, and (ii) a VL comprising a VL CDR1, VL CDR2, and VL CDR3 having an amino acid sequence of SEQ ID NOs:3700, 3701, and 3702, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:3703; and (ii) a VL comprising a VL CDR1, a VL CDR2, and a VL CDR3 having an amino acid sequence of a VL CDR1, a VL CDR2, and a VL CDR3, respectively, of SEQ ID NO:3704. In one aspect, provided herein is an antibody that binds CD4, comprising a VH having an amino acid sequence of SEQ ID NO:3703. In one aspect, provided herein is an antibody that binds CD4, comprising a VL having an amino acid sequence of SEQ ID NO:3704. In one aspect, provided herein is an antibody that binds CD4, comprising a VH having an amino acid sequence of SEQ ID NO:3703, and a VL having an amino acid sequence of SEQ ID NO:3704. In one aspect, provided herein is an antibody that binds CD4, comprising a VH having an amino acid sequence having at least 95% identity to an amino acid sequence of SEQ ID NO:3703. In one aspect, provided herein is an antibody that binds CD4, comprising a VL having an amino acid sequence having at least 95% identity to an amino acid sequence of SEQ ID NO:3704. In one aspect, provided herein is an antibody that binds CD4, comprising a VH having an amino acid sequence having at least 95% identity to an amino acid sequence of SEQ ID NO:3703, and a VL having an amino acid sequence having at least 95% identity to an amino acid sequence of SEQ ID NO:3704.

In one aspect, provided herein is an antibody that binds CD4, comprising: (i) a VH comprising a VH CDR1, a VH CDR2, and a VH CDR3 having an amino acid sequence of SEQ ID NOs:3707, 3708, and 3709, respectively, and (ii) a VL comprising a VL CDR1, VL CDR2, and VL CDR3 having an amino acid sequence of SEQ ID NOs:3710, 3711, and 3712, respectively. In one aspect, provided herein is an antibody that binds CD4, comprising: (i) a VH comprising a VH CDR1, a VH CDR2, and a VH CDR3 having an amino acid sequence of SEQ ID NOs:3713, 3714, and 3715, respectively, and (ii) a VL comprising a VL CDR1, VL CDR2, and VL CDR3 having an amino acid sequence of SEQ ID NOs:3716, 3717, and 3718, respectively. In one aspect, provided herein is an antibody that binds CD4, comprising: (i) a VH comprising a VH CDR1, a VH CDR2, and a VH CDR3 having an amino acid sequence of SEQ ID NOs:3719, 3720, and 3721, respectively, and (ii) a VL comprising a VL CDR1, VL CDR2, and VL CDR3 having an amino acid sequence of SEQ ID NOs:3722, 3723, and 3724, respectively. In one aspect, provided herein is an antibody that binds CD4, comprising: (i) a VH comprising a VH CDR1, a VH CDR2, and a VH CDR3 having an amino acid sequence of SEQ ID NOs:3725, 3726, and 3727, respectively, and (ii) a VL comprising a VL CDR1, VL CDR2, and VL CDR3 having an amino acid sequence of SEQ ID NOs:3728, 3729, and 3730, respectively. In one aspect, provided herein is an antibody that binds CD4, comprising: (i) a VH comprising a VH CDR1, a VH CDR2, and a VH CDR3 having an amino acid sequence of SEQ ID NOs:3731, 3732, and 3733, respectively, and (ii) a VL comprising a VL CDR1, VL CDR2, and VL CDR3 having an amino acid sequence of SEQ ID NOs:3734, 3735, and 3736, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:3737; and (ii) a VL comprising a VL CDR1, a VL CDR2, and a VL CDR3 having an amino acid sequence of a VL CDR1, a VL CDR2, and a VL CDR3, respectively, of SEQ ID NO:3738. In one aspect, provided herein is an antibody that binds CD4, comprising a VH having an amino acid sequence of SEQ ID NO:3737. In one aspect, provided herein is an antibody that binds CD4, comprising a VL having an amino acid sequence of SEQ ID NO:3738. In one aspect, provided herein is an antibody that binds CD4, comprising a VH having an amino acid sequence of SEQ ID NO:3737, and a VL having an amino acid sequence of SEQ ID NO:3738. In one aspect, provided herein is an antibody that binds CD4, comprising a VH having an amino acid sequence having at least 95% identity to an amino acid sequence of SEQ ID NO:3737. In one aspect, provided herein is an antibody that binds CD4, comprising a VL having an amino acid sequence having at least 95% identity to an amino acid sequence of SEQ ID NO:3738. In one aspect, provided herein is an antibody that binds CD4, comprising a VH having an amino acid sequence having at least 95% identity to an amino acid sequence of SEQ ID NO:3737, and a VL having an amino acid sequence having at least 95% identity to an amino acid sequence of SEQ ID NO:3738.

In one aspect, provided herein is an antibody that binds CD4, comprising: (i) a VH comprising a VH CDR1, a VH CDR2, and a VH CDR3 having an amino acid sequence of SEQ ID NOs:3741, 3742, and 3743, respectively, and (ii) a VL comprising a VL CDR1, VL CDR2, and VL CDR3 having an amino acid sequence of SEQ ID NOs:3744, 3745, and 3746, respectively. In one aspect, provided herein is an antibody that binds CD4, comprising: (i) a VH comprising a VH CDR1, a VH CDR2, and a VH CDR3 having an amino acid sequence of SEQ ID NOs:3747, 3748, and 3749, respectively, and (ii) a VL comprising a VL CDR1, VL CDR2, and VL CDR3 having an amino acid sequence of SEQ ID NOs:3750, 3751, and 3752, respectively. In one aspect, provided herein is an antibody that binds CD4, comprising: (i) a VH comprising a VH CDR1, a VH CDR2, and a VH CDR3 having an amino acid sequence of SEQ ID NOs:3753, 3754, and 3755, respectively, and (ii) a VL comprising a VL CDR1, VL CDR2, and VL CDR3 having an amino acid sequence of SEQ ID NOs:3756, 3757, and 3758, respectively. In one aspect, provided herein is an antibody that binds CD4, comprising: (i) a VH comprising a VH CDR1, a VH CDR2, and a VH CDR3 having an amino acid sequence of SEQ ID NOs:3759, 3760, and 3761, respectively, and (ii) a VL comprising a VL CDR1, VL CDR2, and VL CDR3 having an amino acid sequence of SEQ ID NOs:3762, 3763, and 3764, respectively. In one aspect, provided herein is an antibody that binds CD4, comprising: (i) a VH comprising a VH CDR1, a VH CDR2, and a VH CDR3 having an amino acid sequence of SEQ ID NOs:3765, 3766, and 3767, respectively, and (ii) a VL comprising a VL CDR1, VL CDR2, and VL CDR3 having an amino acid sequence of SEQ ID NOs:3768, 3769, and 3770, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:3771; and (ii) a VL comprising a VL CDR1, a VL CDR2, and a VL CDR3 having an amino acid sequence of a VL CDR1, a VL CDR2, and a VL CDR3, respectively, of SEQ ID NO:3772. In one aspect, provided herein is an antibody that binds CD4, comprising a VH having an amino acid sequence of SEQ ID NO:3771. In one aspect, provided herein is an antibody that binds CD4, comprising a VL having an amino acid sequence of SEQ ID NO:3772. In one aspect, provided herein is an antibody that binds CD4, comprising a VH having an amino acid sequence of SEQ ID NO:3771, and a VL having an amino acid sequence of SEQ ID NO:3772. In one aspect, provided herein is an antibody that binds CD4, comprising a VH having an amino acid sequence having at least 95% identity to an amino acid sequence of SEQ ID NO:3771. In one aspect, provided herein is an antibody that binds CD4, comprising a VL having an amino acid sequence having at least 95% identity to an amino acid sequence of SEQ ID NO:3772. In one aspect, provided herein is an antibody that binds CD4, comprising a VH having an amino acid sequence having at least 95% identity to an amino acid sequence of SEQ ID NO:3771, and a VL having an amino acid sequence having at least 95% identity to an amino acid sequence of SEQ ID NO:3772.

In one aspect, provided herein is an antibody that binds CD4, comprising: (i) a VH comprising a VH CDR1, a VH CDR2, and a VH CDR3 having an amino acid sequence of SEQ ID NOs:3775, 3776, and 3777, respectively, and (ii) a VL comprising a VL CDR1, VL CDR2, and VL CDR3 having an amino acid sequence of SEQ ID NOs:3778, 3779, and 3780, respectively. In one aspect, provided herein is an antibody that binds CD4, comprising: (i) a VH comprising a VH CDR1, a VH CDR2, and a VH CDR3 having an amino acid sequence of SEQ ID NOs:3781, 3782, and 3783, respectively, and (ii) a VL comprising a VL CDR1, VL CDR2, and VL CDR3 having an amino acid sequence of SEQ ID NOs:3784, 3785, and 3786, respectively. In one aspect, provided herein is an antibody that binds CD4, comprising: (i) a VH comprising a VH CDR1, a VH CDR2, and a VH CDR3 having an amino acid sequence of SEQ ID NOs:3787, 3788, and 3789, respectively, and (ii) a VL comprising a VL CDR1, VL CDR2, and VL CDR3 having an amino acid sequence of SEQ ID NOs:3790, 3791, and 3792, respectively. In one aspect, provided herein is an antibody that binds CD4, comprising: (i) a VH comprising a VH CDR1, a VH CDR2, and a VH CDR3 having an amino acid sequence of SEQ ID NOs:3793, 3794, and 3795, respectively, and (ii) a VL comprising a VL CDR1, VL CDR2, and VL CDR3 having an amino acid sequence of SEQ ID NOs:3796, 3797, and 3798, respectively. In one aspect, provided herein is an antibody that binds CD4, comprising: (i) a VH comprising a VH CDR1, a VH CDR2, and a VH CDR3 having an amino acid sequence of SEQ ID NOs:3799, 3800, and 3801, respectively, and (ii) a VL comprising a VL CDR1, VL CDR2, and VL CDR3 having an amino acid sequence of SEQ ID NOs:3802, 3803, and 3804, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:3805; and (ii) a VL comprising a VL CDR1, a VL CDR2, and a VL CDR3 having an amino acid sequence of a VL CDR1, a VL CDR2, and a VL CDR3, respectively, of SEQ ID NO:3806. In one aspect, provided herein is an antibody that binds CD4, comprising a VH having an amino acid sequence of SEQ ID NO:3805. In one aspect, provided herein is an antibody that binds CD4, comprising a VL having an amino acid sequence of SEQ ID NO:3806. In one aspect, provided herein is an antibody that binds CD4, comprising a VH having an amino acid sequence of SEQ ID NO:3805, and a VL having an amino acid sequence of SEQ ID NO:3806. In one aspect, provided herein is an antibody that binds CD4, comprising a VH having an amino acid sequence having at least 95% identity to an amino acid sequence of SEQ ID NO:3805. In one aspect, provided herein is an antibody that binds CD4, comprising a VL having an amino acid sequence having at least 95% identity to an amino acid sequence of SEQ ID NO:3806. In one aspect, provided herein is an antibody that binds CD4, comprising a VH having an amino acid sequence having at least 95% identity to an amino acid sequence of SEQ ID NO:3805, and a VL having an amino acid sequence having at least 95% identity to an amino acid sequence of SEQ ID NO:3806.

In one aspect, provided herein is an antibody that binds CD4, comprising: (i) a VH comprising a VH CDR1, a VH CDR2, and a VH CDR3 having an amino acid sequence of SEQ ID NOs:3809, 3810, and 3811, respectively, and (ii) a VL comprising a VL CDR1, VL CDR2, and VL CDR3 having an amino acid sequence of SEQ ID NOs:3812, 3813, and 3814, respectively. In one aspect, provided herein is an antibody that binds CD4, comprising: (i) a VH comprising a VH CDR1, a VH CDR2, and a VH CDR3 having an amino acid sequence of SEQ ID NOs:3815, 3816, and 3817, respectively, and (ii) a VL comprising a VL CDR1, VL CDR2, and VL CDR3 having an amino acid sequence of SEQ ID NOs:3818, 3819, and 3820, respectively. In one aspect, provided herein is an antibody that binds CD4, comprising: (i) a VH comprising a VH CDR1, a VH CDR2, and a VH CDR3 having an amino acid sequence of SEQ ID NOs:3821, 3822, and 3823, respectively, and (ii) a VL comprising a VL CDR1, VL CDR2, and VL CDR3 having an amino acid sequence of SEQ ID NOs:3824, 3825, and 3826, respectively. In one aspect, provided herein is an antibody that binds CD4, comprising: (i) a VH comprising a VH CDR1, a VH CDR2, and a VH CDR3 having an amino acid sequence of SEQ ID NOs:3827, 3828, and 3829, respectively, and (ii) a VL comprising a VL CDR1, VL CDR2, and VL CDR3 having an amino acid sequence of SEQ ID NOs:3830, 3831, and 3832, respectively. In one aspect, provided herein is an antibody that binds CD4, comprising: (i) a VH comprising a VH CDR1, a VH CDR2, and a VH CDR3 having an amino acid sequence of SEQ ID NOs:3833, 3834, and 3835, respectively, and (ii) a VL comprising a VL CDR1, VL CDR2, and VL CDR3 having an amino acid sequence of SEQ ID NOs:3836, 3837, and 3838, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:3839; and (ii) a VL comprising a VL CDR1, a VL CDR2, and a VL CDR3 having an amino acid sequence of a VL CDR1, a VL CDR2, and a VL CDR3, respectively, of SEQ ID NO:3840. In one aspect, provided herein is an antibody that binds CD4, comprising a VH having an amino acid sequence of SEQ ID NO:3839. In one aspect, provided herein is an antibody that binds CD4, comprising a VL having an amino acid sequence of SEQ ID NO:3840. In one aspect, provided herein is an antibody that binds CD4, comprising a VH having an amino acid sequence of SEQ ID NO:3839, and a VL having an amino acid sequence of SEQ ID NO:3840. In one aspect, provided herein is an antibody that binds CD4, comprising a VH having an amino acid sequence having at least 95% identity to an amino acid sequence of SEQ ID NO:3839. In one aspect, provided herein is an antibody that binds CD4, comprising a VL having an amino acid sequence having at least 95% identity to an amino acid sequence of SEQ ID NO:3840. In one aspect, provided herein is an antibody that binds CD4, comprising a VH having an amino acid sequence having at least 95% identity to an amino acid sequence of SEQ ID NO:3839, and a VL having an amino acid sequence having at least 95% identity to an amino acid sequence of SEQ ID NO:3840.

In one aspect, provided herein is an antibody that binds CD4, comprising: (i) a VH comprising a VH CDR1, a VH CDR2, and a VH CDR3 having an amino acid sequence of SEQ ID NOs:3843, 3844, and 3845, respectively, and (ii) a VL comprising a VL CDR1, VL CDR2, and VL CDR3 having an amino acid sequence of SEQ ID NOs:3846, 3847, and 3848, respectively. In one aspect, provided herein is an antibody that binds CD4, comprising: (i) a VH comprising a VH CDR1, a VH CDR2, and a VH CDR3 having an amino acid sequence of SEQ ID NOs:3849, 3850, and 3851, respectively, and (ii) a VL comprising a VL CDR1, VL CDR2, and VL CDR3 having an amino acid sequence of SEQ ID NOs:3852, 3853, and 3854, respectively. In one aspect, provided herein is an antibody that binds CD4, comprising: (i) a VH comprising a VH CDR1, a VH CDR2, and a VH CDR3 having an amino acid sequence of SEQ ID NOs:3855, 3856, and 3857, respectively, and (ii) a VL comprising a VL CDR1, VL CDR2, and VL CDR3 having an amino acid sequence of SEQ ID NOs:3858, 3859, and 3860, respectively. In one aspect, provided herein is an antibody that binds CD4, comprising: (i) a VH comprising a VH CDR1, a VH CDR2, and a VH CDR3 having an amino acid sequence of SEQ ID NOs:3861, 3862, and 3863, respectively, and (ii) a VL comprising a VL CDR1, VL CDR2, and VL CDR3 having an amino acid sequence of SEQ ID NOs:3864, 3865, and 3866, respectively. In one aspect, provided herein is an antibody that binds CD4, comprising: (i) a VH comprising a VH CDR1, a VH CDR2, and a VH CDR3 having an amino acid sequence of SEQ ID NOs:3867, 3868, and 3869, respectively, and (ii) a VL comprising a VL CDR1, VL CDR2, and VL CDR3 having an amino acid sequence of SEQ ID NOs:3870, 3871, and 3872, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:3873; and (ii) a VL comprising a VL CDR1, a VL CDR2, and a VL CDR3 having an amino acid sequence of a VL CDR1, a VL CDR2, and a VL CDR3, respectively, of SEQ ID NO:3874. In one aspect, provided herein is an antibody that binds CD4, comprising a VH having an amino acid sequence of SEQ ID NO:3873. In one aspect, provided herein is an antibody that binds CD4, comprising a VL having an amino acid sequence of SEQ ID NO:3874. In one aspect, provided herein is an antibody that binds CD4, comprising a VH having an amino acid sequence of SEQ ID NO:3873, and a VL having an amino acid sequence of SEQ ID NO:3874. In one aspect, provided herein is an antibody that binds CD4, comprising a heavy chain having an amino acid sequence of SEQ ID NO:3875. In one aspect, provided herein is an antibody that binds CD4, comprising a light chain having an amino acid sequence of SEQ ID NO:3876. In one aspect, provided herein is an antibody that binds CD4, comprising a heavy chain having an amino acid sequence of SEQ ID NO:3875, and a light chain having an amino acid sequence of SEQ ID NO:3876. In one aspect, provided herein is an antibody that binds CD4, comprising a VH having an amino acid sequence having at least 95% identity to an amino acid sequence of SEQ ID NO:3873. In one aspect, provided herein is an antibody that binds CD4, comprising a VL having an amino acid sequence having at least 95% identity to an amino acid sequence of SEQ ID NO:3874. In one aspect, provided herein is an antibody that binds CD4, comprising a VH having an amino acid sequence having at least 95% identity to an amino acid sequence of SEQ ID NO:3873, and a VL having an amino acid sequence having at least 95% identity to an amino acid sequence of SEQ ID NO:3874. In one aspect, provided herein is an antibody that binds CD4, comprising a heavy chain having an amino acid sequence having at least 95% identity to an amino acid sequence of SEQ ID NO:3875. In one aspect, provided herein is an antibody that binds CD4, comprising a light chain having an amino acid sequence having at least 95% identity to an amino acid sequence of SEQ ID NO:3876. In one aspect, provided herein is an antibody that binds CD4, comprising a heavy chain having an amino acid sequence having at least 95% identity to an amino acid sequence of SEQ ID NO:3875, and a light chain having an amino acid sequence having at least 95% identity to an amino acid sequence of SEQ ID NO:3876.

In one aspect, provided herein is an antibody that binds CD4, comprising: (i) a VH comprising a VH CDR1, a VH CDR2, and a VH CDR3 having an amino acid sequence of SEQ ID NOs:3877, 3878, and 3879, respectively, and (ii) a VL comprising a VL CDR1, VL CDR2, and VL CDR3 having an amino acid sequence of SEQ ID NOs:3880, 3881, and 3882, respectively. In one aspect, provided herein is an antibody that binds CD4, comprising: (i) a VH comprising a VH CDR1, a VH CDR2, and a VH CDR3 having an amino acid sequence of SEQ ID NOs:3883, 3884, and 3885, respectively, and (ii) a VL comprising a VL CDR1, VL CDR2, and VL CDR3 having an amino acid sequence of SEQ ID NOs:3886, 3887, and 3888, respectively. In one aspect, provided herein is an antibody that binds CD4, comprising: (i) a VH comprising a VH CDR1, a VH CDR2, and a VH CDR3 having an amino acid sequence of SEQ ID NOs:3889, 3890, and 3891, respectively, and (ii) a VL comprising a VL CDR1, VL CDR2, and VL CDR3 having an amino acid sequence of SEQ ID NOs:3892, 3893, and 3894, respectively. In one aspect, provided herein is an antibody that binds CD4, comprising: (i) a VH comprising a VH CDR1, a VH CDR2, and a VH CDR3 having an amino acid sequence of SEQ ID NOs:3895, 3896, and 3897, respectively, and (ii) a VL comprising a VL CDR1, VL CDR2, and VL CDR3 having an amino acid sequence of SEQ ID NOs:3898, 3899, and 3900, respectively. In one aspect, provided herein is an antibody that binds CD4, comprising: (i) a VH comprising a VH CDR1, a VH CDR2, and a VH CDR3 having an amino acid sequence of SEQ ID NOs:3901, 3902, and 3903, respectively, and (ii) a VL comprising a VL CDR1, VL CDR2, and VL CDR3 having an amino acid sequence of SEQ ID NOs:3904, 3905, and 3906, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:3907; and (ii) a VL comprising a VL CDR1, a VL CDR2, and a VL CDR3 having an amino acid sequence of a VL CDR1, a VL CDR2, and a VL CDR3, respectively, of SEQ ID NO:3908. In one aspect, provided herein is an antibody that binds CD4, comprising a VH having an amino acid sequence of SEQ ID NO:3907. In one aspect, provided herein is an antibody that binds CD4, comprising a VL having an amino acid sequence of SEQ ID NO:3908. In one aspect, provided herein is an antibody that binds CD4, comprising a VH having an amino acid sequence of SEQ ID NO:3907, and a VL having an amino acid sequence of SEQ ID NO:3908. In one aspect, provided herein is an antibody that binds CD4, comprising a VH having an amino acid sequence having at least 95% identity to an amino acid sequence of SEQ ID NO:3907. In one aspect, provided herein is an antibody that binds CD4, comprising a VL having an amino acid sequence having at least 95% identity to an amino acid sequence of SEQ ID NO:3908. In one aspect, provided herein is an antibody that binds CD4, comprising a VH having an amino acid sequence having at least 95% identity to an amino acid sequence of SEQ ID NO:3907, and a VL having an amino acid sequence having at least 95% identity to an amino acid sequence of SEQ ID NO:3908.

In one aspect, provided herein is an antibody that binds CD4, comprising: (i) a VH comprising a VH CDR1, a VH CDR2, and a VH CDR3 having an amino acid sequence of SEQ ID NOs:3911, 3912, and 3913, respectively, and (ii) a VL comprising a VL CDR1, VL CDR2, and VL CDR3 having an amino acid sequence of SEQ ID NOs:3914, 3915, and 3916, respectively. In one aspect, provided herein is an antibody that binds CD4, comprising: (i) a VH comprising a VH CDR1, a VH CDR2, and a VH CDR3 having an amino acid sequence of SEQ ID NOs:3917, 3918, and 3919, respectively, and (ii) a VL comprising a VL CDR1, VL CDR2, and VL CDR3 having an amino acid sequence of SEQ ID NOs:3920, 3921, and 3922, respectively. In one aspect, provided herein is an antibody that binds CD4, comprising: (i) a VH comprising a VH CDR1, a VH CDR2, and a VH CDR3 having an amino acid sequence of SEQ ID NOs:3923, 3924, and 3925, respectively, and (ii) a VL comprising a VL CDR1, VL CDR2, and VL CDR3 having an amino acid sequence of SEQ ID NOs:3926, 3927, and 3928, respectively. In one aspect, provided herein is an antibody that binds CD4, comprising: (i) a VH comprising a VH CDR1, a VH CDR2, and a VH CDR3 having an amino acid sequence of SEQ ID NOs:3929, 3930, and 3931, respectively, and (ii) a VL comprising a VL CDR1, VL CDR2, and VL CDR3 having an amino acid sequence of SEQ ID NOs:3932, 3933, and 3934, respectively. In one aspect, provided herein is an antibody that binds CD4, comprising: (i) a VH comprising a VH CDR1, a VH CDR2, and a VH CDR3 having an amino acid sequence of SEQ ID NOs:3935, 3936, and 3937, respectively, and (ii) a VL comprising a VL CDR1, VL CDR2, and VL CDR3 having an amino acid sequence of SEQ ID NOs:3938, 3939, and 3940, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:3941; and (ii) a VL comprising a VL CDR1, a VL CDR2, and a VL CDR3 having an amino acid sequence of a VL CDR1, a VL CDR2, and a VL CDR3, respectively, of SEQ ID NO:3942. In one aspect, provided herein is an antibody that binds CD4, comprising a VH having an amino acid sequence of SEQ ID NO:3941. In one aspect, provided herein is an antibody that binds CD4, comprising a VL having an amino acid sequence of SEQ ID NO:3942. In one aspect, provided herein is an antibody that binds CD4, comprising a VH having an amino acid sequence of SEQ ID NO:3941, and a VL having an amino acid sequence of SEQ ID NO:3942. In one aspect, provided herein is an antibody that binds CD4, comprising a VH having an amino acid sequence having at least 95% identity to an amino acid sequence of SEQ ID NO:3941. In one aspect, provided herein is an antibody that binds CD4, comprising a VL having an amino acid sequence having at least 95% identity to an amino acid sequence of SEQ ID NO:3942. In one aspect, provided herein is an antibody that binds CD4, comprising a VH having an amino acid sequence having at least 95% identity to an amino acid sequence of SEQ ID NO:3941, and a VL having an amino acid sequence having at least 95% identity to an amino acid sequence of SEQ ID NO:3942.

In one aspect, provided herein is an antibody that binds CD4, comprising: (i) a VH comprising a VH CDR1, a VH CDR2, and a VH CDR3 having an amino acid sequence of SEQ ID NOs:3945, 3946, and 3947, respectively, and (ii) a VL comprising a VL CDR1, VL CDR2, and VL CDR3 having an amino acid sequence of SEQ ID NOs:3948, 3949, and 3950, respectively. In one aspect, provided herein is an antibody that binds CD4, comprising: (i) a VH comprising a VH CDR1, a VH CDR2, and a VH CDR3 having an amino acid sequence of SEQ ID NOs:3951, 3952, and 3953, respectively, and (ii) a VL comprising a VL CDR1, VL CDR2, and VL CDR3 having an amino acid sequence of SEQ ID NOs:3954, 3955, and 3956, respectively. In one aspect, provided herein is an antibody that binds CD4, comprising: (i) a VH comprising a VH CDR1, a VH CDR2, and a VH CDR3 having an amino acid sequence of SEQ ID NOs:3957, 3958, and 3959, respectively, and (ii) a VL comprising a VL CDR1, VL CDR2, and VL CDR3 having an amino acid sequence of SEQ ID NOs:3960, 3961, and 3962, respectively. In one aspect, provided herein is an antibody that binds CD4, comprising: (i) a VH comprising a VH CDR1, a VH CDR2, and a VH CDR3 having an amino acid sequence of SEQ ID NOs:3963, 3964, and 3965, respectively, and (ii) a VL comprising a VL CDR1, VL CDR2, and VL CDR3 having an amino acid sequence of SEQ ID NOs:3966, 3967, and 3968, respectively. In one aspect, provided herein is an antibody that binds CD4, comprising: (i) a VH comprising a VH CDR1, a VH CDR2, and a VH CDR3 having an amino acid sequence of SEQ ID NOs:3969, 3970, and 3971, respectively, and (ii) a VL comprising a VL CDR1, VL CDR2, and VL CDR3 having an amino acid sequence of SEQ ID NOs:3972, 3973, and 3974, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:3975; and (ii) a VL comprising a VL CDR1, a VL CDR2, and a VL CDR3 having an amino acid sequence of a VL CDR1, a VL CDR2, and a VL CDR3, respectively, of SEQ ID NO:3976. In one aspect, provided herein is an antibody that binds CD4, comprising a VH having an amino acid sequence of SEQ ID NO:3975. In one aspect, provided herein is an antibody that binds CD4, comprising a VL having an amino acid sequence of SEQ ID NO:3976. In one aspect, provided herein is an antibody that binds CD4, comprising a VH having an amino acid sequence of SEQ ID NO:3975, and a VL having an amino acid sequence of SEQ ID NO:3976. In one aspect, provided herein is an antibody that binds CD4, comprising a heavy chain having an amino acid sequence of SEQ ID NO:3977. In one aspect, provided herein is an antibody that binds CD4, comprising a light chain having an amino acid sequence of SEQ ID NO:3978. In one aspect, provided herein is an antibody that binds CD4, comprising a heavy chain having an amino acid sequence of SEQ ID NO:3977, and a light chain having an amino acid sequence of SEQ ID NO:3978. In one aspect, provided herein is an antibody that binds CD4, comprising a VH having an amino acid sequence having at least 95% identity to an amino acid sequence of SEQ ID NO:3975. In one aspect, provided herein is an antibody that binds CD4, comprising a VL having an amino acid sequence having at least 95% identity to an amino acid sequence of SEQ ID NO:3976. In one aspect, provided herein is an antibody that binds CD4, comprising a VH having an amino acid sequence having at least 95% identity to an amino acid sequence of SEQ ID NO:3975, and a VL having an amino acid sequence having at least 95% identity to an amino acid sequence of SEQ ID NO:3976. In one aspect, provided herein is an antibody that binds CD4, comprising a heavy chain having an amino acid sequence having at least 95% identity to an amino acid sequence of SEQ ID NO:3977. In one aspect, provided herein is an antibody that binds CD4, comprising a light chain having an amino acid sequence having at least 95% identity to an amino acid sequence of SEQ ID NO:3978. In one aspect, provided herein is an antibody that binds CD4, comprising a heavy chain having an amino acid sequence having at least 95% identity to an amino acid sequence of SEQ ID NO:3977, and a light chain having an amino acid sequence having at least 95% identity to an amino acid sequence of SEQ ID NO:3978.

In one aspect, provided herein is an antibody that binds CD4, comprising: (i) a VH comprising a VH CDR1, a VH CDR2, and a VH CDR3 having an amino acid sequence of SEQ ID NOs:3979, 3980, and 3981, respectively, and (ii) a VL comprising a VL CDR1, VL CDR2, and VL CDR3 having an amino acid sequence of SEQ ID NOs:3982, 3983, and 3984, respectively. In one aspect, provided herein is an antibody that binds CD4, comprising: (i) a VH comprising a VH CDR1, a VH CDR2, and a VH CDR3 having an amino acid sequence of SEQ ID NOs:3985, 3986, and 3987, respectively, and (ii) a VL comprising a VL CDR1, VL CDR2, and VL CDR3 having an amino acid sequence of SEQ ID NOs:3988, 3989, and 3990, respectively. In one aspect, provided herein is an antibody that binds CD4, comprising: (i) a VH comprising a VH CDR1, a VH CDR2, and a VH CDR3 having an amino acid sequence of SEQ ID NOs:3991, 3992, and 3993, respectively, and (ii) a VL comprising a VL CDR1, VL CDR2, and VL CDR3 having an amino acid sequence of SEQ ID NOs:3994, 3995, and 3996, respectively. In one aspect, provided herein is an antibody that binds CD4, comprising: (i) a VH comprising a VH CDR1, a VH CDR2, and a VH CDR3 having an amino acid sequence of SEQ ID NOs:3997, 3998, and 3999, respectively, and (ii) a VL comprising a VL CDR1, VL CDR2, and VL CDR3 having an amino acid sequence of SEQ ID NOs:4000, 4001, and 4002, respectively. In one aspect, provided herein is an antibody that binds CD4, comprising: (i) a VH comprising a VH CDR1, a VH CDR2, and a VH CDR3 having an amino acid sequence of SEQ ID NOs:4003, 4004, and 4005, respectively, and (ii) a VL comprising a VL CDR1, VL CDR2, and VL CDR3 having an amino acid sequence of SEQ ID NOs:4006, 4007, and 4008, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:4009; and (ii) a VL comprising a VL CDR1, a VL CDR2, and a VL CDR3 having an amino acid sequence of a VL CDR1, a VL CDR2, and a VL CDR3, respectively, of SEQ ID NO:4010. In one aspect, provided herein is an antibody that binds CD4, comprising a VH having an amino acid sequence of SEQ ID NO:4009. In one aspect, provided herein is an antibody that binds CD4, comprising a VL having an amino acid sequence of SEQ ID NO:4010. In one aspect, provided herein is an antibody that binds CD4, comprising a VH having an amino acid sequence of SEQ ID NO:4009, and a VL having an amino acid sequence of SEQ ID NO:4010. In one aspect, provided herein is an antibody that binds CD4, comprising a VH having an amino acid sequence having at least 95% identity to an amino acid sequence of SEQ ID NO:4009. In one aspect, provided herein is an antibody that binds CD4, comprising a VL having an amino acid sequence having at least 95% identity to an amino acid sequence of SEQ ID NO:4010. In one aspect, provided herein is an antibody that binds CD4, comprising a VH having an amino acid sequence having at least 95% identity to an amino acid sequence of SEQ ID NO:4009, and a VL having an amino acid sequence having at least 95% identity to an amino acid sequence of SEQ ID NO:4010.

In one aspect, provided herein is an antibody that binds CD4, comprising: (i) a VH comprising a VH CDR1, a VH CDR2, and a VH CDR3 having an amino acid sequence of SEQ ID NOs:4013, 4014, and 4015, respectively, and (ii) a VL comprising a VL CDR1, VL CDR2, and VL CDR3 having an amino acid sequence of SEQ ID NOs:4016, 4017, and 4018, respectively. In one aspect, provided herein is an antibody that binds CD4, comprising: (i) a VH comprising a VH CDR1, a VH CDR2, and a VH CDR3 having an amino acid sequence of SEQ ID NOs:4019, 4020, and 4021, respectively, and (ii) a VL comprising a VL CDR1, VL CDR2, and VL CDR3 having an amino acid sequence of SEQ ID NOs:4022, 4023, and 4024, respectively. In one aspect, provided herein is an antibody that binds CD4, comprising: (i) a VH comprising a VH CDR1, a VH CDR2, and a VH CDR3 having an amino acid sequence of SEQ ID NOs:4025, 4026, and 4027, respectively, and (ii) a VL comprising a VL CDR1, VL CDR2, and VL CDR3 having an amino acid sequence of SEQ ID NOs:4028, 4029, and 4030, respectively. In one aspect, provided herein is an antibody that binds CD4, comprising: (i) a VH comprising a VH CDR1, a VH CDR2, and a VH CDR3 having an amino acid sequence of SEQ ID NOs:4031, 4032, and 4033, respectively, and (ii) a VL comprising a VL CDR1, VL CDR2, and VL CDR3 having an amino acid sequence of SEQ ID NOs:4034, 4035, and 4036, respectively. In one aspect, provided herein is an antibody that binds CD4, comprising: (i) a VH comprising a VH CDR1, a VH CDR2, and a VH CDR3 having an amino acid sequence of SEQ ID NOs:4037, 4038, and 4039, respectively, and (ii) a VL comprising a VL CDR1, VL CDR2, and VL CDR3 having an amino acid sequence of SEQ ID NOs:4040, 4041, and 4042, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:4043; and (ii) a VL comprising a VL CDR1, a VL CDR2, and a VL CDR3 having an amino acid sequence of a VL CDR1, a VL CDR2, and a VL CDR3, respectively, of SEQ ID NO:4044. In one aspect, provided herein is an antibody that binds CD4, comprising a VH having an amino acid sequence of SEQ ID NO:4043. In one aspect, provided herein is an antibody that binds CD4, comprising a VL having an amino acid sequence of SEQ ID NO:4044. In one aspect, provided herein is an antibody that binds CD4, comprising a VH having an amino acid sequence of SEQ ID NO:4043, and a VL having an amino acid sequence of SEQ ID NO:4044. In one aspect, provided herein is an antibody that binds CD4, comprising a VH having an amino acid sequence having at least 95% identity to an amino acid sequence of SEQ ID NO:4043. In one aspect, provided herein is an antibody that binds CD4, comprising a VL having an amino acid sequence having at least 95% identity to an amino acid sequence of SEQ ID NO:4044. In one aspect, provided herein is an antibody that binds CD4, comprising a VH having an amino acid sequence having at least 95% identity to an amino acid sequence of SEQ ID NO:4043, and a VL having an amino acid sequence having at least 95% identity to an amino acid sequence of SEQ ID NO:4044.

In one aspect, provided herein is an antibody that binds CD4, comprising: (i) a VH comprising a VH CDR1, a VH CDR2, and a VH CDR3 having an amino acid sequence of SEQ ID NOs:4047, 4048, and 4049, respectively, and (ii) a VL comprising a VL CDR1, VL CDR2, and VL CDR3 having an amino acid sequence of SEQ ID NOs:4050, 4051, and 4052, respectively. In one aspect, provided herein is an antibody that binds CD4, comprising: (i) a VH comprising a VH CDR1, a VH CDR2, and a VH CDR3 having an amino acid sequence of SEQ ID NOs:4053, 4054, and 4055, respectively, and (ii) a VL comprising a VL CDR1, VL CDR2, and VL CDR3 having an amino acid sequence of SEQ ID NOs:4056, 4057, and 4058, respectively. In one aspect, provided herein is an antibody that binds CD4, comprising: (i) a VH comprising a VH CDR1, a VH CDR2, and a VH CDR3 having an amino acid sequence of SEQ ID NOs:4059, 4060, and 4061, respectively, and (ii) a VL comprising a VL CDR1, VL CDR2, and VL CDR3 having an amino acid sequence of SEQ ID NOs:4062, 4063, and 4064, respectively. In one aspect, provided herein is an antibody that binds CD4, comprising: (i) a VH comprising a VH CDR1, a VH CDR2, and a VH CDR3 having an amino acid sequence of SEQ ID NOs:4065, 4066, and 4067, respectively, and (ii) a VL comprising a VL CDR1, VL CDR2, and VL CDR3 having an amino acid sequence of SEQ ID NOs:4068, 4069, and 4070, respectively. In one aspect, provided herein is an antibody that binds CD4, comprising: (i) a VH comprising a VH CDR1, a VH CDR2, and a VH CDR3 having an amino acid sequence of SEQ ID NOs:4071, 4072, and 4073, respectively, and (ii) a VL comprising a VL CDR1, VL CDR2, and VL CDR3 having an amino acid sequence of SEQ ID NOs:4074, 4075, and 4076, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:4077; and (ii) a VL comprising a VL CDR1, a VL CDR2, and a VL CDR3 having an amino acid sequence of a VL CDR1, a VL CDR2, and a VL CDR3, respectively, of SEQ ID NO:4078. In one aspect, provided herein is an antibody that binds CD4, comprising a VH having an amino acid sequence of SEQ ID NO:4077. In one aspect, provided herein is an antibody that binds CD4, comprising a VL having an amino acid sequence of SEQ ID NO:4078. In one aspect, provided herein is an antibody that binds CD4, comprising a VH having an amino acid sequence of SEQ ID NO:4077, and a VL having an amino acid sequence of SEQ ID NO:4078. In one aspect, provided herein is an antibody that binds CD4, comprising a VH having an amino acid sequence having at least 95% identity to an amino acid sequence of SEQ ID NO:4077. In one aspect, provided herein is an antibody that binds CD4, comprising a VL having an amino acid sequence having at least 95% identity to an amino acid sequence of SEQ ID NO:4078. In one aspect, provided herein is an antibody that binds CD4, comprising a VH having an amino acid sequence having at least 95% identity to an amino acid sequence of SEQ ID NO:4077, and a VL having an amino acid sequence having at least 95% identity to an amino acid sequence of SEQ ID NO:4078.

In one aspect, provided herein is an antibody that binds CD4, comprising: (i) a VH comprising a VH CDR1, a VH CDR2, and a VH CDR3 having an amino acid sequence of SEQ ID NOs:4081, 4082, and 4083, respectively, and (ii) a VL comprising a VL CDR1, VL CDR2, and VL CDR3 having an amino acid sequence of SEQ ID NOs:4084, 4085, and 4086, respectively. In one aspect, provided herein is an antibody that binds CD4, comprising: (i) a VH comprising a VH CDR1, a VH CDR2, and a VH CDR3 having an amino acid sequence of SEQ ID NOs:4087, 4088, and 4089, respectively, and (ii) a VL comprising a VL CDR1, VL CDR2, and VL CDR3 having an amino acid sequence of SEQ ID NOs:4090, 4091, and 4092, respectively. In one aspect, provided herein is an antibody that binds CD4, comprising: (i) a VH comprising a VH CDR1, a VH CDR2, and a VH CDR3 having an amino acid sequence of SEQ ID NOs:4093, 4094, and 4095, respectively, and (ii) a VL comprising a VL CDR1, VL CDR2, and VL CDR3 having an amino acid sequence of SEQ ID NOs:4096, 4097, and 4098, respectively. In one aspect, provided herein is an antibody that binds CD4, comprising: (i) a VH comprising a VH CDR1, a VH CDR2, and a VH CDR3 having an amino acid sequence of SEQ ID NOs:4099, 4100, and 4101, respectively, and (ii) a VL comprising a VL CDR1, VL CDR2, and VL CDR3 having an amino acid sequence of SEQ ID NOs:4102, 4103, and 4104, respectively. In one aspect, provided herein is an antibody that binds CD4, comprising: (i) a VH comprising a VH CDR1, a VH CDR2, and a VH CDR3 having an amino acid sequence of SEQ ID NOs:4105, 4106, and 4107, respectively, and (ii) a VL comprising a VL CDR1, VL CDR2, and VL CDR3 having an amino acid sequence of SEQ ID NOs:4108, 4109, and 4110, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:4111; and (ii) a VL comprising a VL CDR1, a VL CDR2, and a VL CDR3 having an amino acid sequence of a VL CDR1, a VL CDR2, and a VL CDR3, respectively, of SEQ ID NO:4112. In one aspect, provided herein is an antibody that binds CD4, comprising a VH having an amino acid sequence of SEQ ID NO:4111. In one aspect, provided herein is an antibody that binds CD4, comprising a VL having an amino acid sequence of SEQ ID NO:4112. In one aspect, provided herein is an antibody that binds CD4, comprising a VH having an amino acid sequence of SEQ ID NO:4111, and a VL having an amino acid sequence of SEQ ID NO:4112. In one aspect, provided herein is an antibody that binds CD4, comprising a VH having an amino acid sequence having at least 95% identity to an amino acid sequence of SEQ ID NO:4111. In one aspect, provided herein is an antibody that binds CD4, comprising a VL having an amino acid sequence having at least 95% identity to an amino acid sequence of SEQ ID NO:4112. In one aspect, provided herein is an antibody that binds CD4, comprising a VH having an amino acid sequence having at least 95% identity to an amino acid sequence of SEQ ID NO:4111, and a VL having an amino acid sequence having at least 95% identity to an amino acid sequence of SEQ ID NO:4112.

In one aspect, provided herein is an antibody that binds CD4, comprising: (i) a VH comprising a VH CDR1, a VH CDR2, and a VH CDR3 having an amino acid sequence of SEQ ID NOs:4115, 4116, and 4117, respectively, and (ii) a VL comprising a VL CDR1, VL CDR2, and VL CDR3 having an amino acid sequence of SEQ ID NOs:4118, 4119, and 4120, respectively. In one aspect, provided herein is an antibody that binds CD4, comprising: (i) a VH comprising a VH CDR1, a VH CDR2, and a VH CDR3 having an amino acid sequence of SEQ ID NOs:4121, 4122, and 4123, respectively, and (ii) a VL comprising a VL CDR1, VL CDR2, and VL CDR3 having an amino acid sequence of SEQ ID NOs:4124, 4125, and 4126, respectively. In one aspect, provided herein is an antibody that binds CD4, comprising: (i) a VH comprising a VH CDR1, a VH CDR2, and a VH CDR3 having an amino acid sequence of SEQ ID NOs:4127, 4128, and 4129, respectively, and (ii) a VL comprising a VL CDR1, VL CDR2, and VL CDR3 having an amino acid sequence of SEQ ID NOs:4130, 4131, and 4132, respectively. In one aspect, provided herein is an antibody that binds CD4, comprising: (i) a VH comprising a VH CDR1, a VH CDR2, and a VH CDR3 having an amino acid sequence of SEQ ID NOs:4133, 4134, and 4135, respectively, and (ii) a VL comprising a VL CDR1, VL CDR2, and VL CDR3 having an amino acid sequence of SEQ ID NOs:4136, 4137, and 4138, respectively. In one aspect, provided herein is an antibody that binds CD4, comprising: (i) a VH comprising a VH CDR1, a VH CDR2, and a VH CDR3 having an amino acid sequence of SEQ ID NOs:4139, 4140, and 4141, respectively, and (ii) a VL comprising a VL CDR1, VL CDR2, and VL CDR3 having an amino acid sequence of SEQ ID NOs:4142, 4143, and 4144, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:4145; and (ii) a VL comprising a VL CDR1, a VL CDR2, and a VL CDR3 having an amino acid sequence of a VL CDR1, a VL CDR2, and a VL CDR3, respectively, of SEQ ID NO:4146. In one aspect, provided herein is an antibody that binds CD4, comprising a VH having an amino acid sequence of SEQ ID NO:4145. In one aspect, provided herein is an antibody that binds CD4, comprising a VL having an amino acid sequence of SEQ ID NO:4146. In one aspect, provided herein is an antibody that binds CD4, comprising a VH having an amino acid sequence of SEQ ID NO:4145, and a VL having an amino acid sequence of SEQ ID NO:4146. In one aspect, provided herein is an antibody that binds CD4, comprising a VH having an amino acid sequence having at least 95% identity to an amino acid sequence of SEQ ID NO:4145. In one aspect, provided herein is an antibody that binds CD4, comprising a VL having an amino acid sequence having at least 95% identity to an amino acid sequence of SEQ ID NO:4146. In one aspect, provided herein is an antibody that binds CD4, comprising a VH having an amino acid sequence having at least 95% identity to an amino acid sequence of SEQ ID NO:4145, and a VL having an amino acid sequence having at least 95% identity to an amino acid sequence of SEQ ID NO:4146.

In one aspect, provided herein is an antibody that binds CD4, comprising: (i) a VH comprising a VH CDR1, a VH CDR2, and a VH CDR3 having an amino acid sequence of SEQ ID NOs:4149, 4150, and 4151, respectively, and (ii) a VL comprising a VL CDR1, VL CDR2, and VL CDR3 having an amino acid sequence of SEQ ID NOs:4152, 4153, and 4154, respectively. In one aspect, provided herein is an antibody that binds CD4, comprising: (i) a VH comprising a VH CDR1, a VH CDR2, and a VH CDR3 having an amino acid sequence of SEQ ID NOs:4155, 4156, and 4157, respectively, and (ii) a VL comprising a VL CDR1, VL CDR2, and VL CDR3 having an amino acid sequence of SEQ ID NOs:4158, 4159, and 4160, respectively. In one aspect, provided herein is an antibody that binds CD4, comprising: (i) a VH comprising a VH CDR1, a VH CDR2, and a VH CDR3 having an amino acid sequence of SEQ ID NOs:4161, 4162, and 4163, respectively, and (ii) a VL comprising a VL CDR1, VL CDR2, and VL CDR3 having an amino acid sequence of SEQ ID NOs:4164, 4165, and 4166, respectively. In one aspect, provided herein is an antibody that binds CD4, comprising: (i) a VH comprising a VH CDR1, a VH CDR2, and a VH CDR3 having an amino acid sequence of SEQ ID NOs:4167, 4168, and 4169, respectively, and (ii) a VL comprising a VL CDR1, VL CDR2, and VL CDR3 having an amino acid sequence of SEQ ID NOs:4170, 4171, and 4172, respectively. In one aspect, provided herein is an antibody that binds CD4, comprising: (i) a VH comprising a VH CDR1, a VH CDR2, and a VH CDR3 having an amino acid sequence of SEQ ID NOs:4173, 4174, and 4175, respectively, and (ii) a VL comprising a VL CDR1, VL CDR2, and VL CDR3 having an amino acid sequence of SEQ ID NOs:4176, 4177, and 4178, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:4179; and (ii) a VL comprising a VL CDR1, a VL CDR2, and a VL CDR3 having an amino acid sequence of a VL CDR1, a VL CDR2, and a VL CDR3, respectively, of SEQ ID NO:4180. In one aspect, provided herein is an antibody that binds CD4, comprising a VH having an amino acid sequence of SEQ ID NO:4179. In one aspect, provided herein is an antibody that binds CD4, comprising a VL having an amino acid sequence of SEQ ID NO:4180. In one aspect, provided herein is an antibody that binds CD4, comprising a VH having an amino acid sequence of SEQ ID NO:4179, and a VL having an amino acid sequence of SEQ ID NO:4180. In one aspect, provided herein is an antibody that binds CD4, comprising a heavy chain having an amino acid sequence of SEQ ID NO:4181. In one aspect, provided herein is an antibody that binds CD4, comprising a light chain having an amino acid sequence of SEQ ID NO:4182. In one aspect, provided herein is an antibody that binds CD4, comprising a heavy chain having an amino acid sequence of SEQ ID NO:4181, and a light chain having an amino acid sequence of SEQ ID NO:4182. In one aspect, provided herein is an antibody that binds CD4, comprising a VH having an amino acid sequence having at least 95% identity to an amino acid sequence of SEQ ID NO:4179. In one aspect, provided herein is an antibody that binds CD4, comprising a VL having an amino acid sequence having at least 95% identity to an amino acid sequence of SEQ ID NO:4180. In one aspect, provided herein is an antibody that binds CD4, comprising a VH having an amino acid sequence having at least 95% identity to an amino acid sequence of SEQ ID NO:4179, and a VL having an amino acid sequence having at least 95% identity to an amino acid sequence of SEQ ID NO:4180. In one aspect, provided herein is an antibody that binds CD4, comprising a heavy chain having an amino acid sequence having at least 95% identity to an amino acid sequence of SEQ ID NO:4181. In one aspect, provided herein is an antibody that binds CD4, comprising a light chain having an amino acid sequence having at least 95% identity to an amino acid sequence of SEQ ID NO:4182. In one aspect, provided herein is an antibody that binds CD4, comprising a heavy chain having an amino acid sequence having at least 95% identity to an amino acid sequence of SEQ ID NO:4181, and a light chain having an amino acid sequence having at least 95% identity to an amino acid sequence of SEQ ID NO:4182.

In one aspect, provided herein is an antibody that binds CD4, comprising: (i) a VH comprising a VH CDR1, a VH CDR2, and a VH CDR3 having an amino acid sequence of SEQ ID NOs:4183, 4184, and 4185, respectively, and (ii) a VL comprising a VL CDR1, VL CDR2, and VL CDR3 having an amino acid sequence of SEQ ID NOs:4186, 4187, and 4188, respectively. In one aspect, provided herein is an antibody that binds CD4, comprising: (i) a VH comprising a VH CDR1, a VH CDR2, and a VH CDR3 having an amino acid sequence of SEQ ID NOs:4189, 4190, and 4191, respectively, and (ii) a VL comprising a VL CDR1, VL CDR2, and VL CDR3 having an amino acid sequence of SEQ ID NOs:4192, 4193, and 4194, respectively. In one aspect, provided herein is an antibody that binds CD4, comprising: (i) a VH comprising a VH CDR1, a VH CDR2, and a VH CDR3 having an amino acid sequence of SEQ ID NOs:4195, 4196, and 4197, respectively, and (ii) a VL comprising a VL CDR1, VL CDR2, and VL CDR3 having an amino acid sequence of SEQ ID NOs:4198, 4199, and 4200, respectively. In one aspect, provided herein is an antibody that binds CD4, comprising: (i) a VH comprising a VH CDR1, a VH CDR2, and a VH CDR3 having an amino acid sequence of SEQ ID NOs:4201, 4202, and 4203, respectively, and (ii) a VL comprising a VL CDR1, VL CDR2, and VL CDR3 having an amino acid sequence of SEQ ID NOs:4204, 4205, and 4206, respectively. In one aspect, provided herein is an antibody that binds CD4, comprising: (i) a VH comprising a VH CDR1, a VH CDR2, and a VH CDR3 having an amino acid sequence of SEQ ID NOs:4207, 4208, and 4209, respectively, and (ii) a VL comprising a VL CDR1, VL CDR2, and VL CDR3 having an amino acid sequence of SEQ ID NOs:4210, 4211, and 4212, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:4213; and (ii) a VL comprising a VL CDR1, a VL CDR2, and a VL CDR3 having an amino acid sequence of a VL CDR1, a VL CDR2, and a VL CDR3, respectively, of SEQ ID NO:4214. In one aspect, provided herein is an antibody that binds CD4, comprising a VH having an amino acid sequence of SEQ ID NO:4213. In one aspect, provided herein is an antibody that binds CD4, comprising a VL having an amino acid sequence of SEQ ID NO:4214. In one aspect, provided herein is an antibody that binds CD4, comprising a VH having an amino acid sequence of SEQ ID NO:4213, and a VL having an amino acid sequence of SEQ ID NO:4214. In one aspect, provided herein is an antibody that binds CD4, comprising a heavy chain having an amino acid sequence of SEQ ID NO:4215. In one aspect, provided herein is an antibody that binds CD4, comprising a light chain having an amino acid sequence of SEQ ID NO:4216. In one aspect, provided herein is an antibody that binds CD4, comprising a heavy chain having an amino acid sequence of SEQ ID NO:4215, and a light chain having an amino acid sequence of SEQ ID NO:4216. In one aspect, provided herein is an antibody that binds CD4, comprising a VH having an amino acid sequence having at least 95% identity to an amino acid sequence of SEQ ID NO:4213. In one aspect, provided herein is an antibody that binds CD4, comprising a VL having an amino acid sequence having at least 95% identity to an amino acid sequence of SEQ ID NO:4214. In one aspect, provided herein is an antibody that binds CD4, comprising a VH having an amino acid sequence having at least 95% identity to an amino acid sequence of SEQ ID NO:4213, and a VL having an amino acid sequence having at least 95% identity to an amino acid sequence of SEQ ID NO:4214. In one aspect, provided herein is an antibody that binds CD4, comprising a heavy chain having an amino acid sequence having at least 95% identity to an amino acid sequence of SEQ ID NO:4215. In one aspect, provided herein is an antibody that binds CD4, comprising a light chain having an amino acid sequence having at least 95% identity to an amino acid sequence of SEQ ID NO:4216. In one aspect, provided herein is an antibody that binds CD4, comprising a heavy chain having an amino acid sequence having at least 95% identity to an amino acid sequence of SEQ ID NO:4215, and a light chain having an amino acid sequence having at least 95% identity to an amino acid sequence of SEQ ID NO:4216.

In one aspect, provided herein is an antibody that binds CD4, comprising: (i) a VH comprising a VH CDR1, a VH CDR2, and a VH CDR3 having an amino acid sequence of SEQ ID NOs:4217, 4218, and 4219, respectively, and (ii) a VL comprising a VL CDR1, VL CDR2, and VL CDR3 having an amino acid sequence of SEQ ID NOs:4220, 4221, and 4222, respectively. In one aspect, provided herein is an antibody that binds CD4, comprising: (i) a VH comprising a VH CDR1, a VH CDR2, and a VH CDR3 having an amino acid sequence of SEQ ID NOs:4223, 4224, and 4225, respectively, and (ii) a VL comprising a VL CDR1, VL CDR2, and VL CDR3 having an amino acid sequence of SEQ ID NOs:4226, 4227, and 4228, respectively. In one aspect, provided herein is an antibody that binds CD4, comprising: (i) a VH comprising a VH CDR1, a VH CDR2, and a VH CDR3 having an amino acid sequence of SEQ ID NOs:4229, 4230, and 4231, respectively, and (ii) a VL comprising a VL CDR1, VL CDR2, and VL CDR3 having an amino acid sequence of SEQ ID NOs:4232, 4233, and 4234, respectively. In one aspect, provided herein is an antibody that binds CD4, comprising: (i) a VH comprising a VH CDR1, a VH CDR2, and a VH CDR3 having an amino acid sequence of SEQ ID NOs:4235, 4236, and 4237, respectively, and (ii) a VL comprising a VL CDR1, VL CDR2, and VL CDR3 having an amino acid sequence of SEQ ID NOs:4238, 4239, and 4240, respectively. In one aspect, provided herein is an antibody that binds CD4, comprising: (i) a VH comprising a VH CDR1, a VH CDR2, and a VH CDR3 having an amino acid sequence of SEQ ID NOs:4241, 4242, and 4243, respectively, and (ii) a VL comprising a VL CDR1, VL CDR2, and VL CDR3 having an amino acid sequence of SEQ ID NOs:4244, 4245, and 4246, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:4247; and (ii) a VL comprising a VL CDR1, a VL CDR2, and a VL CDR3 having an amino acid sequence of a VL CDR1, a VL CDR2, and a VL CDR3, respectively, of SEQ ID NO:4248. In one aspect, provided herein is an antibody that binds CD4, comprising a VH having an amino acid sequence of SEQ ID NO:4247. In one aspect, provided herein is an antibody that binds CD4, comprising a VL having an amino acid sequence of SEQ ID NO:4248. In one aspect, provided herein is an antibody that binds CD4, comprising a VH having an amino acid sequence of SEQ ID NO:4247, and a VL having an amino acid sequence of SEQ ID NO:4248. In one aspect, provided herein is an antibody that binds CD4, comprising a VH having an amino acid sequence having at least 95% identity to an amino acid sequence of SEQ ID NO:4247. In one aspect, provided herein is an antibody that binds CD4, comprising a VL having an amino acid sequence having at least 95% identity to an amino acid sequence of SEQ ID NO:4248. In one aspect, provided herein is an antibody that binds CD4, comprising a VH having an amino acid sequence having at least 95% identity to an amino acid sequence of SEQ ID NO:4247, and a VL having an amino acid sequence having at least 95% identity to an amino acid sequence of SEQ ID NO:4248.

In one aspect, provided herein is an antibody that binds CD4, comprising: (i) a VH comprising a VH CDR1, a VH CDR2, and a VH CDR3 having an amino acid sequence of SEQ ID NOs:4251, 4252, and 4253, respectively, and (ii) a VL comprising a VL CDR1, VL CDR2, and VL CDR3 having an amino acid sequence of SEQ ID NOs:4254, 4255, and 4256, respectively. In one aspect, provided herein is an antibody that binds CD4, comprising: (i) a VH comprising a VH CDR1, a VH CDR2, and a VH CDR3 having an amino acid sequence of SEQ ID NOs:4257, 4258, and 4259, respectively, and (ii) a VL comprising a VL CDR1, VL CDR2, and VL CDR3 having an amino acid sequence of SEQ ID NOs:4260, 4261, and 4262, respectively. In one aspect, provided herein is an antibody that binds CD4, comprising: (i) a VH comprising a VH CDR1, a VH CDR2, and a VH CDR3 having an amino acid sequence of SEQ ID NOs:4263, 4264, and 4265, respectively, and (ii) a VL comprising a VL CDR1, VL CDR2, and VL CDR3 having an amino acid sequence of SEQ ID NOs:4266, 4267, and 4268, respectively. In one aspect, provided herein is an antibody that binds CD4, comprising: (i) a VH comprising a VH CDR1, a VH CDR2, and a VH CDR3 having an amino acid sequence of SEQ ID NOs:4269, 4270, and 4271, respectively, and (ii) a VL comprising a VL CDR1, VL CDR2, and VL CDR3 having an amino acid sequence of SEQ ID NOs:4272, 4273, and 4274, respectively. In one aspect, provided herein is an antibody that binds CD4, comprising: (i) a VH comprising a VH CDR1, a VH CDR2, and a VH CDR3 having an amino acid sequence of SEQ ID NOs:4275, 4276, and 4277, respectively, and (ii) a VL comprising a VL CDR1, VL CDR2, and VL CDR3 having an amino acid sequence of SEQ ID NOs:4278, 4279, and 4280, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:4281; and (ii) a VL comprising a VL CDR1, a VL CDR2, and a VL CDR3 having an amino acid sequence of a VL CDR1, a VL CDR2, and a VL CDR3, respectively, of SEQ ID NO:4282. In one aspect, provided herein is an antibody that binds CD4, comprising a VH having an amino acid sequence of SEQ ID NO:4281. In one aspect, provided herein is an antibody that binds CD4, comprising a VL having an amino acid sequence of SEQ ID NO:4282. In one aspect, provided herein is an antibody that binds CD4, comprising a VH having an amino acid sequence of SEQ ID NO:4281, and a VL having an amino acid sequence of SEQ ID NO:4282. In one aspect, provided herein is an antibody that binds CD4, comprising a heavy chain having an amino acid sequence of SEQ ID NO:4283. In one aspect, provided herein is an antibody that binds CD4, comprising a light chain having an amino acid sequence of SEQ ID NO:4284. In one aspect, provided herein is an antibody that binds CD4, comprising a heavy chain having an amino acid sequence of SEQ ID NO:4283, and a light chain having an amino acid sequence of SEQ ID NO:4284. In one aspect, provided herein is an antibody that binds CD4, comprising a VH having an amino acid sequence having at least 95% identity to an amino acid sequence of SEQ ID NO:4281. In one aspect, provided herein is an antibody that binds CD4, comprising a VL having an amino acid sequence having at least 95% identity to an amino acid sequence of SEQ ID NO:4282. In one aspect, provided herein is an antibody that binds CD4, comprising a VH having an amino acid sequence having at least 95% identity to an amino acid sequence of SEQ ID NO:4281, and a VL having an amino acid sequence having at least 95% identity to an amino acid sequence of SEQ ID NO:4282. In one aspect, provided herein is an antibody that binds CD4, comprising a heavy chain having an amino acid sequence having at least 95% identity to an amino acid sequence of SEQ ID NO:4283. In one aspect, provided herein is an antibody that binds CD4, comprising a light chain having an amino acid sequence having at least 95% identity to an amino acid sequence of SEQ ID NO:4284. In one aspect, provided herein is an antibody that binds CD4, comprising a heavy chain having an amino acid sequence having at least 95% identity to an amino acid sequence of SEQ ID NO:4283, and a light chain having an amino acid sequence having at least 95% identity to an amino acid sequence of SEQ ID NO:4284.

In one aspect, provided herein is an antibody that binds CD4, comprising: (i) a VH comprising a VH CDR1, a VH CDR2, and a VH CDR3 having an amino acid sequence of SEQ ID NOs:4285, 4286, and 4287, respectively, and (ii) a VL comprising a VL CDR1, VL CDR2, and VL CDR3 having an amino acid sequence of SEQ ID NOs:4288, 4289, and 4290, respectively. In one aspect, provided herein is an antibody that binds CD4, comprising: (i) a VH comprising a VH CDR1, a VH CDR2, and a VH CDR3 having an amino acid sequence of SEQ ID NOs:4291, 4292, and 4293, respectively, and (ii) a VL comprising a VL CDR1, VL CDR2, and VL CDR3 having an amino acid sequence of SEQ ID NOs:4294, 4295, and 4296, respectively. In one aspect, provided herein is an antibody that binds CD4, comprising: (i) a VH comprising a VH CDR1, a VH CDR2, and a VH CDR3 having an amino acid sequence of SEQ ID NOs:4297, 4298, and 4299, respectively, and (ii) a VL comprising a VL CDR1, VL CDR2, and VL CDR3 having an amino acid sequence of SEQ ID NOs:4300, 4301, and 4302, respectively. In one aspect, provided herein is an antibody that binds CD4, comprising: (i) a VH comprising a VH CDR1, a VH CDR2, and a VH CDR3 having an amino acid sequence of SEQ ID NOs:4303, 4304, and 4305, respectively, and (ii) a VL comprising a VL CDR1, VL CDR2, and VL CDR3 having an amino acid sequence of SEQ ID NOs:4306, 4307, and 4308, respectively. In one aspect, provided herein is an antibody that binds CD4, comprising: (i) a VH comprising a VH CDR1, a VH CDR2, and a VH CDR3 having an amino acid sequence of SEQ ID NOs:4309, 4310, and 4311, respectively, and (ii) a VL comprising a VL CDR1, VL CDR2, and VL CDR3 having an amino acid sequence of SEQ ID NOs:4312, 4313, and 4314, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:4315; and (ii) a VL comprising a VL CDR1, a VL CDR2, and a VL CDR3 having an amino acid sequence of a VL CDR1, a VL CDR2, and a VL CDR3, respectively, of SEQ ID NO:4316. In one aspect, provided herein is an antibody that binds CD4, comprising a VH having an amino acid sequence of SEQ ID NO:4315. In one aspect, provided herein is an antibody that binds CD4, comprising a VL having an amino acid sequence of SEQ ID NO:4316. In one aspect, provided herein is an antibody that binds CD4, comprising a VH having an amino acid sequence of SEQ ID NO:4315, and a VL having an amino acid sequence of SEQ ID NO:4316. In one aspect, provided herein is an antibody that binds CD4, comprising a heavy chain having an amino acid sequence of SEQ ID NO:4317. In one aspect, provided herein is an antibody that binds CD4, comprising a light chain having an amino acid sequence of SEQ ID NO:4318. In one aspect, provided herein is an antibody that binds CD4, comprising a heavy chain having an amino acid sequence of SEQ ID NO:4317, and a light chain having an amino acid sequence of SEQ ID NO:4318. In one aspect, provided herein is an antibody that binds CD4, comprising a VH having an amino acid sequence having at least 95% identity to an amino acid sequence of SEQ ID NO:4315. In one aspect, provided herein is an antibody that binds CD4, comprising a VL having an amino acid sequence having at least 95% identity to an amino acid sequence of SEQ ID NO:4316. In one aspect, provided herein is an antibody that binds CD4, comprising a VH having an amino acid sequence having at least 95% identity to an amino acid sequence of SEQ ID NO:4315, and a VL having an amino acid sequence having at least 95% identity to an amino acid sequence of SEQ ID NO:4316. In one aspect, provided herein is an antibody that binds CD4, comprising a heavy chain having an amino acid sequence having at least 95% identity to an amino acid sequence of SEQ ID NO:4317. In one aspect, provided herein is an antibody that binds CD4, comprising a light chain having an amino acid sequence having at least 95% identity to an amino acid sequence of SEQ ID NO:4318. In one aspect, provided herein is an antibody that binds CD4, comprising a heavy chain having an amino acid sequence having at least 95% identity to an amino acid sequence of SEQ ID NO:4317, and a light chain having an amino acid sequence having at least 95% identity to an amino acid sequence of SEQ ID NO:4318.

In one aspect, provided herein is an antibody that binds CD4, comprising: (i) a VH comprising a VH CDR1, a VH CDR2, and a VH CDR3 having an amino acid sequence of SEQ ID NOs:4319, 4320, and 4321, respectively, and (ii) a VL comprising a VL CDR1, VL CDR2, and VL CDR3 having an amino acid sequence of SEQ ID NOs:4322, 4323, and 4324, respectively. In one aspect, provided herein is an antibody that binds CD4, comprising: (i) a VH comprising a VH CDR1, a VH CDR2, and a VH CDR3 having an amino acid sequence of SEQ ID NOs:4325, 4326, and 4327, respectively, and (ii) a VL comprising a VL CDR1, VL CDR2, and VL CDR3 having an amino acid sequence of SEQ ID NOs:4328, 4329, and 4330, respectively. In one aspect, provided herein is an antibody that binds CD4, comprising: (i) a VH comprising a VH CDR1, a VH CDR2, and a VH CDR3 having an amino acid sequence of SEQ ID NOs:4331, 4332, and 4333, respectively, and (ii) a VL comprising a VL CDR1, VL CDR2, and VL CDR3 having an amino acid sequence of SEQ ID NOs:4334, 4335, and 4336, respectively. In one aspect, provided herein is an antibody that binds CD4, comprising: (i) a VH comprising a VH CDR1, a VH CDR2, and a VH CDR3 having an amino acid sequence of SEQ ID NOs:4337, 4338, and 4339, respectively, and (ii) a VL comprising a VL CDR1, VL CDR2, and VL CDR3 having an amino acid sequence of SEQ ID NOs:4340, 4341, and 4342, respectively. In one aspect, provided herein is an antibody that binds CD4, comprising: (i) a VH comprising a VH CDR1, a VH CDR2, and a VH CDR3 having an amino acid sequence of SEQ ID NOs:4343, 4344, and 4345, respectively, and (ii) a VL comprising a VL CDR1, VL CDR2, and VL CDR3 having an amino acid sequence of SEQ ID NOs:4346, 4347, 4348, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:4349; and (ii) a VL comprising a VL CDR1, a VL CDR2, and a VL CDR3 having an amino acid sequence of a VL CDR1, a VL CDR2, and a VL CDR3, respectively, of SEQ ID NO:4350. In one aspect, provided herein is an antibody that binds CD4, comprising a VH having an amino acid sequence of SEQ ID NO:4349. In one aspect, provided herein is an antibody that binds CD4, comprising a VL having an amino acid sequence of SEQ ID NO:4350. In one aspect, provided herein is an antibody that binds CD4, comprising a VH having an amino acid sequence of SEQ ID NO:4349, and a VL having an amino acid sequence of SEQ ID NO:4350. In one aspect, provided herein is an antibody that binds CD4, comprising a VH having an amino acid sequence having at least 95% identity to an amino acid sequence of SEQ ID NO:4349. In one aspect, provided herein is an antibody that binds CD4, comprising a VL having an amino acid sequence having at least 95% identity to an amino acid sequence of SEQ ID NO:4350. In one aspect, provided herein is an antibody that binds CD4, comprising a VH having an amino acid sequence having at least 95% identity to an amino acid sequence of SEQ ID NO:4349, and a VL having an amino acid sequence having at least 95% identity to an amino acid sequence of SEQ ID NO:4350.

In one aspect, provided herein is an antibody that binds CD4, comprising: (i) a VH comprising a VH CDR1, a VH CDR2, and a VH CDR3 having an amino acid sequence of SEQ ID NOs:4353, 4354, and 4355, respectively, and (ii) a VL comprising a VL CDR1, VL CDR2, and VL CDR3 having an amino acid sequence of SEQ ID NOs:4356, 4357, and 4358, respectively. In one aspect, provided herein is an antibody that binds CD4, comprising: (i) a VH comprising a VH CDR1, a VH CDR2, and a VH CDR3 having an amino acid sequence of SEQ ID NOs:4359, 4360, and 4361, respectively, and (ii) a VL comprising a VL CDR1, VL CDR2, and VL CDR3 having an amino acid sequence of SEQ ID NOs:4362, 4363, and 4364, respectively. In one aspect, provided herein is an antibody that binds CD4, comprising: (i) a VH comprising a VH CDR1, a VH CDR2, and a VH CDR3 having an amino acid sequence of SEQ ID NOs:4365, 4366, and 4367, respectively, and (ii) a VL comprising a VL CDR1, VL CDR2, and VL CDR3 having an amino acid sequence of SEQ ID NOs:4368, 4369, and 4370, respectively. In one aspect, provided herein is an antibody that binds CD4, comprising: (i) a VH comprising a VH CDR1, a VH CDR2, and a VH CDR3 having an amino acid sequence of SEQ ID NOs:4371, 4372, and 4373, respectively, and (ii) a VL comprising a VL CDR1, VL CDR2, and VL CDR3 having an amino acid sequence of SEQ ID NOs:4374, 4375, and 4376, respectively. In one aspect, provided herein is an antibody that binds CD4, comprising: (i) a VH comprising a VH CDR1, a VH CDR2, and a VH CDR3 having an amino acid sequence of SEQ ID NOs:4377, 4378, and 4379, respectively, and (ii) a VL comprising a VL CDR1, VL CDR2, and VL CDR3 having an amino acid sequence of SEQ ID NOs:4380, 4381, and 4382, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:4383; and (ii) a VL comprising a VL CDR1, a VL CDR2, and a VL CDR3 having an amino acid sequence of a VL CDR1, a VL CDR2, and a VL CDR3, respectively, of SEQ ID NO:4384. In one aspect, provided herein is an antibody that binds CD4, comprising a VH having an amino acid sequence of SEQ ID NO:4383. In one aspect, provided herein is an antibody that binds CD4, comprising a VL having an amino acid sequence of SEQ ID NO:4384. In one aspect, provided herein is an antibody that binds CD4, comprising a VH having an amino acid sequence of SEQ ID NO:4383, and a VL having an amino acid sequence of SEQ ID NO:4384. In one aspect, provided herein is an antibody that binds CD4, comprising a VH having an amino acid sequence having at least 95% identity to an amino acid sequence of SEQ ID NO:4383. In one aspect, provided herein is an antibody that binds CD4, comprising a VL having an amino acid sequence having at least 95% identity to an amino acid sequence of SEQ ID NO:4384. In one aspect, provided herein is an antibody that binds CD4, comprising a VH having an amino acid sequence having at least 95% identity to an amino acid sequence of SEQ ID NO:4383, and a VL having an amino acid sequence having at least 95% identity to an amino acid sequence of SEQ ID NO:4384.

In one aspect, provided herein is an antibody that binds CD4, comprising: (i) a VH comprising a VH CDR1, a VH CDR2, and a VH CDR3 having an amino acid sequence of SEQ ID NOs:4387, 4388, and 4389, respectively, and (ii) a VL comprising a VL CDR1, VL CDR2, and VL CDR3 having an amino acid sequence of SEQ ID NOs:4390, 4391, and 4392, respectively. In one aspect, provided herein is an antibody that binds CD4, comprising: (i) a VH comprising a VH CDR1, a VH CDR2, and a VH CDR3 having an amino acid sequence of SEQ ID NOs:4393, 4394, and 4395, respectively, and (ii) a VL comprising a VL CDR1, VL CDR2, and VL CDR3 having an amino acid sequence of SEQ ID NOs:4396, 4397, and 4398, respectively. In one aspect, provided herein is an antibody that binds CD4, comprising: (i) a VH comprising a VH CDR1, a VH CDR2, and a VH CDR3 having an amino acid sequence of SEQ ID NOs:4399, 4400, and 4401, respectively, and (ii) a VL comprising a VL CDR1, VL CDR2, and VL CDR3 having an amino acid sequence of SEQ ID NOs:4402, 4403, and 4404, respectively. In one aspect, provided herein is an antibody that binds CD4, comprising: (i) a VH comprising a VH CDR1, a VH CDR2, and a VH CDR3 having an amino acid sequence of SEQ ID NOs:4405, 4406, and 4407, respectively, and (ii) a VL comprising a VL CDR1, VL CDR2, and VL CDR3 having an amino acid sequence of SEQ ID NOs:4408, 4409, and 4410, respectively. In one aspect, provided herein is an antibody that binds CD4, comprising: (i) a VH comprising a VH CDR1, a VH CDR2, and a VH CDR3 having an amino acid sequence of SEQ ID NOs:4411, 4412, and 4413, respectively, and (ii) a VL comprising a VL CDR1, VL CDR2, and VL CDR3 having an amino acid sequence of SEQ ID NOs:4414, 4415, and 4416, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:4417; and (ii) a VL comprising a VL CDR1, a VL CDR2, and a VL CDR3 having an amino acid sequence of a VL CDR1, a VL CDR2, and a VL CDR3, respectively, of SEQ ID NO:4418. In one aspect, provided herein is an antibody that binds CD4, comprising a VH having an amino acid sequence of SEQ ID NO:4417. In one aspect, provided herein is an antibody that binds CD4, comprising a VL having an amino acid sequence of SEQ ID NO:4418. In one aspect, provided herein is an antibody that binds CD4, comprising a VH having an amino acid sequence of SEQ ID NO:4417, and a VL having an amino acid sequence of SEQ ID NO:4418. In one aspect, provided herein is an antibody that binds CD4, comprising a VH having an amino acid sequence having at least 95% identity to an amino acid sequence of SEQ ID NO:4417. In one aspect, provided herein is an antibody that binds CD4, comprising a VL having an amino acid sequence having at least 95% identity to an amino acid sequence of SEQ ID NO:4418. In one aspect, provided herein is an antibody that binds CD4, comprising a VH having an amino acid sequence having at least 95% identity to an amino acid sequence of SEQ ID NO:4417, and a VL having an amino acid sequence having at least 95% identity to an amino acid sequence of SEQ ID NO:4418.

In one aspect, provided herein is an antibody that binds CD4, comprising: (i) a VH comprising a VH CDR1, a VH CDR2, and a VH CDR3 having an amino acid sequence of SEQ ID NOs:4421, 4422, and 4423, respectively, and (ii) a VL comprising a VL CDR1, VL CDR2, and VL CDR3 having an amino acid sequence of SEQ ID NOs:4424, 4425, and 4426, respectively. In one aspect, provided herein is an antibody that binds CD4, comprising: (i) a VH comprising a VH CDR1, a VH CDR2, and a VH CDR3 having an amino acid sequence of SEQ ID NOs:4427, 4428, and 4429, respectively, and (ii) a VL comprising a VL CDR1, VL CDR2, and VL CDR3 having an amino acid sequence of SEQ ID NOs:4430, 4431, and 4432, respectively. In one aspect, provided herein is an antibody that binds CD4, comprising: (i) a VH comprising a VH CDR1, a VH CDR2, and a VH CDR3 having an amino acid sequence of SEQ ID NOs:4433, 4434, and 4435, respectively, and (ii) a VL comprising a VL CDR1, VL CDR2, and VL CDR3 having an amino acid sequence of SEQ ID NOs:4436, 4437, and 4438, respectively. In one aspect, provided herein is an antibody that binds CD4, comprising: (i) a VH comprising a VH CDR1, a VH CDR2, and a VH CDR3 having an amino acid sequence of SEQ ID NOs:4439, 4440, and 4441, respectively, and (ii) a VL comprising a VL CDR1, VL CDR2, and VL CDR3 having an amino acid sequence of SEQ ID NOs:4442, 4443, and 4444, respectively. In one aspect, provided herein is an antibody that binds CD4, comprising: (i) a VH comprising a VH CDR1, a VH CDR2, and a VH CDR3 having an amino acid sequence of SEQ ID NOs:4445, 4446, and 4447, respectively, and (ii) a VL comprising a VL CDR1, VL CDR2, and VL CDR3 having an amino acid sequence of SEQ ID NOs:4448, 4449, and 4450, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:4451; and (ii) a VL comprising a VL CDR1, a VL CDR2, and a VL CDR3 having an amino acid sequence of a VL CDR1, a VL CDR2, and a VL CDR3, respectively, of SEQ ID NO:4452. In one aspect, provided herein is an antibody that binds CD4, comprising a VH having an amino acid sequence of SEQ ID NO:4451. In one aspect, provided herein is an antibody that binds CD4, comprising a VL having an amino acid sequence of SEQ ID NO:4452. In one aspect, provided herein is an antibody that binds CD4, comprising a VH having an amino acid sequence of SEQ ID NO:4451, and a VL having an amino acid sequence of SEQ ID NO:4452. In one aspect, provided herein is an antibody that binds CD4, comprising a VH having an amino acid sequence having at least 95% identity to an amino acid sequence of SEQ ID NO:4451. In one aspect, provided herein is an antibody that binds CD4, comprising a VL having an amino acid sequence having at least 95% identity to an amino acid sequence of SEQ ID NO:4452. In one aspect, provided herein is an antibody that binds CD4, comprising a VH having an amino acid sequence having at least 95% identity to an amino acid sequence of SEQ ID NO:4451, and a VL having an amino acid sequence having at least 95% identity to an amino acid sequence of SEQ ID NO:4452.

In one aspect, provided herein is an antibody that binds CD4, comprising: (i) a VH comprising a VH CDR1, a VH CDR2, and a VH CDR3 having an amino acid sequence of SEQ ID NOs:4455, 4456, and 4457, respectively, and (ii) a VL comprising a VL CDR1, VL CDR2, and VL CDR3 having an amino acid sequence of SEQ ID NOs:4458, 4459, and 4460, respectively. In one aspect, provided herein is an antibody that binds CD4, comprising: (i) a VH comprising a VH CDR1, a VH CDR2, and a VH CDR3 having an amino acid sequence of SEQ ID NOs:4461, 4462, and 4463, respectively, and (ii) a VL comprising a VL CDR1, VL CDR2, and VL CDR3 having an amino acid sequence of SEQ ID NOs:4464, 4465, and 4466, respectively. In one aspect, provided herein is an antibody that binds CD4, comprising: (i) a VH comprising a VH CDR1, a VH CDR2, and a VH CDR3 having an amino acid sequence of SEQ ID NOs:4467, 4468, and 4469, respectively, and (ii) a VL comprising a VL CDR1, VL CDR2, and VL CDR3 having an amino acid sequence of SEQ ID NOs:4470, 4471, and 4472, respectively. In one aspect, provided herein is an antibody that binds CD4, comprising: (i) a VH comprising a VH CDR1, a VH CDR2, and a VH CDR3 having an amino acid sequence of SEQ ID NOs:4473, 4474, and 4475, respectively, and (ii) a VL comprising a VL CDR1, VL CDR2, and VL CDR3 having an amino acid sequence of SEQ ID NOs:4476, 4477, and 4478, respectively. In one aspect, provided herein is an antibody that binds CD4, comprising: (i) a VH comprising a VH CDR1, a VH CDR2, and a VH CDR3 having an amino acid sequence of SEQ ID NOs:4479, 4480, and 4481, respectively, and (ii) a VL comprising a VL CDR1, VL CDR2, and VL CDR3 having an amino acid sequence of SEQ ID NOs:4482, 4483, and 4484, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:4485; and (ii) a VL comprising a VL CDR1, a VL CDR2, and a VL CDR3 having an amino acid sequence of a VL CDR1, a VL CDR2, and a VL CDR3, respectively, of SEQ ID NO:4486. In one aspect, provided herein is an antibody that binds CD4, comprising a VH having an amino acid sequence of SEQ ID NO:4485. In one aspect, provided herein is an antibody that binds CD4, comprising a VL having an amino acid sequence of SEQ ID NO:4486. In one aspect, provided herein is an antibody that binds CD4, comprising a VH having an amino acid sequence of SEQ ID NO:4485, and a VL having an amino acid sequence of SEQ ID NO:4486. In one aspect, provided herein is an antibody that binds CD4, comprising a VH having an amino acid sequence having at least 95% identity to an amino acid sequence of SEQ ID NO:4485. In one aspect, provided herein is an antibody that binds CD4, comprising a VL having an amino acid sequence having at least 95% identity to an amino acid sequence of SEQ ID NO:4486. In one aspect, provided herein is an antibody that binds CD4, comprising a VH having an amino acid sequence having at least 95% identity to an amino acid sequence of SEQ ID NO:4485, and a VL having an amino acid sequence having at least 95% identity to an amino acid sequence of SEQ ID NO:4486.

In one aspect, provided herein is an antibody that binds CD4, comprising: (i) a VH comprising a VH CDR1, a VH CDR2, and a VH CDR3 having an amino acid sequence of SEQ ID NOs:4489, 4490, and 4491, respectively, and (ii) a VL comprising a VL CDR1, VL CDR2, and VL CDR3 having an amino acid sequence of SEQ ID NOs:4492, 4493, and 4494, respectively. In one aspect, provided herein is an antibody that binds CD4, comprising: (i) a VH comprising a VH CDR1, a VH CDR2, and a VH CDR3 having an amino acid sequence of SEQ ID NOs:4495, 4496, and 4497, respectively, and (ii) a VL comprising a VL CDR1, VL CDR2, and VL CDR3 having an amino acid sequence of SEQ ID NOs:4498, 4499, and 4500, respectively. In one aspect, provided herein is an antibody that binds CD4, comprising: (i) a VH comprising a VH CDR1, a VH CDR2, and a VH CDR3 having an amino acid sequence of SEQ ID NOs:4501, 4502, and 4503, respectively, and (ii) a VL comprising a VL CDR1, VL CDR2, and VL CDR3 having an amino acid sequence of SEQ ID NOs:4504, 4505, and 4506, respectively. In one aspect, provided herein is an antibody that binds CD4, comprising: (i) a VH comprising a VH CDR1, a VH CDR2, and a VH CDR3 having an amino acid sequence of SEQ ID NOs:4507, 4508, and 4509, respectively, and (ii) a VL comprising a VL CDR1, VL CDR2, and VL CDR3 having an amino acid sequence of SEQ ID NOs:4510, 4511, and 4512, respectively. In one aspect, provided herein is an antibody that binds CD4, comprising: (i) a VH comprising a VH CDR1, a VH CDR2, and a VH CDR3 having an amino acid sequence of SEQ ID NOs:4513, 4514, and 4515, respectively, and (ii) a VL comprising a VL CDR1, VL CDR2, and VL CDR3 having an amino acid sequence of SEQ ID NOs:4516, 4517, and 4518, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:4519; and (ii) a VL comprising a VL CDR1, a VL CDR2, and a VL CDR3 having an amino acid sequence of a VL CDR1, a VL CDR2, and a VL CDR3, respectively, of SEQ ID NO:4520. In one aspect, provided herein is an antibody that binds CD4, comprising a VH having an amino acid sequence of SEQ ID NO:4519. In one aspect, provided herein is an antibody that binds CD4, comprising a VL having an amino acid sequence of SEQ ID NO:4520. In one aspect, provided herein is an antibody that binds CD4, comprising a VH having an amino acid sequence of SEQ ID NO:4519, and a VL having an amino acid sequence of SEQ ID NO:4520. In one aspect, provided herein is an antibody that binds CD4, comprising a VH having an amino acid sequence having at least 95% identity to an amino acid sequence of SEQ ID NO:4519. In one aspect, provided herein is an antibody that binds CD4, comprising a VL having an amino acid sequence having at least 95% identity to an amino acid sequence of SEQ ID NO:4520. In one aspect, provided herein is an antibody that binds CD4, comprising a VH having an amino acid sequence having at least 95% identity to an amino acid sequence of SEQ ID NO:4519, and a VL having an amino acid sequence having at least 95% identity to an amino acid sequence of SEQ ID NO:4520.

In one aspect, provided herein is an antibody that binds CD4, comprising: (i) a VH comprising a VH CDR1, a VH CDR2, and a VH CDR3 having an amino acid sequence of SEQ ID NOs:4523, 4524, and 4525, respectively, and (ii) a VL comprising a VL CDR1, VL CDR2, and VL CDR3 having an amino acid sequence of SEQ ID NOs:4526, 4527, and 4528, respectively. In one aspect, provided herein is an antibody that binds CD4, comprising: (i) a VH comprising a VH CDR1, a VH CDR2, and a VH CDR3 having an amino acid sequence of SEQ ID NOs:4529, 4530, and 4531, respectively, and (ii) a VL comprising a VL CDR1, VL CDR2, and VL CDR3 having an amino acid sequence of SEQ ID NOs:4532, 4533, and 4534, respectively. In one aspect, provided herein is an antibody that binds CD4, comprising: (i) a VH comprising a VH CDR1, a VH CDR2, and a VH CDR3 having an amino acid sequence of SEQ ID NOs:4535, 4536, and 4537, respectively, and (ii) a VL comprising a VL CDR1, VL CDR2, and VL CDR3 having an amino acid sequence of SEQ ID NOs:4538, 4539, and 4540, respectively. In one aspect, provided herein is an antibody that binds CD4, comprising: (i) a VH comprising a VH CDR1, a VH CDR2, and a VH CDR3 having an amino acid sequence of SEQ ID NOs:4541, 4542, and 4543, respectively, and (ii) a VL comprising a VL CDR1, VL CDR2, and VL CDR3 having an amino acid sequence of SEQ ID NOs:4544, 4545, and 4546, respectively. In one aspect, provided herein is an antibody that binds CD4, comprising: (i) a VH comprising a VH CDR1, a VH CDR2, and a VH CDR3 having an amino acid sequence of SEQ ID NOs:4547, 4548, and 4549, respectively, and (ii) a VL comprising a VL CDR1, VL CDR2, and VL CDR3 having an amino acid sequence of SEQ ID NOs:4550, 4551, and 4552, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:4553; and (ii) a VL comprising a VL CDR1, a VL CDR2, and a VL CDR3 having an amino acid sequence of a VL CDR1, a VL CDR2, and a VL CDR3, respectively, of SEQ ID NO:4554. In one aspect, provided herein is an antibody that binds CD4, comprising a VH having an amino acid sequence of SEQ ID NO:4553. In one aspect, provided herein is an antibody that binds CD4, comprising a VL having an amino acid sequence of SEQ ID NO:4554. In one aspect, provided herein is an antibody that binds CD4, comprising a VH having an amino acid sequence of SEQ ID NO:4553, and a VL having an amino acid sequence of SEQ ID NO:4554. In one aspect, provided herein is an antibody that binds CD4, comprising a VH having an amino acid sequence having at least 95% identity to an amino acid sequence of SEQ ID NO:4553. In one aspect, provided herein is an antibody that binds CD4, comprising a VL having an amino acid sequence having at least 95% identity to an amino acid sequence of SEQ ID NO:4554. In one aspect, provided herein is an antibody that binds CD4, comprising a VH having an amino acid sequence having at least 95% identity to an amino acid sequence of SEQ ID NO:4553, and a VL having an amino acid sequence having at least 95% identity to an amino acid sequence of SEQ ID NO:4554.

In one aspect, provided herein is an antibody that binds CD4, comprising: (i) a VH comprising a VH CDR1, a VH CDR2, and a VH CDR3 having an amino acid sequence of SEQ ID NOs:4557, 4558, and 4559, respectively, and (ii) a VL comprising a VL CDR1, VL CDR2, and VL CDR3 having an amino acid sequence of SEQ ID NOs:4560, 4561, and 4562, respectively. In one aspect, provided herein is an antibody that binds CD4, comprising: (i) a VH comprising a VH CDR1, a VH CDR2, and a VH CDR3 having an amino acid sequence of SEQ ID NOs:4563, 4564, and 4565, respectively, and (ii) a VL comprising a VL CDR1, VL CDR2, and VL CDR3 having an amino acid sequence of SEQ ID NOs:4566, 4567, and 4568, respectively. In one aspect, provided herein is an antibody that binds CD4, comprising: (i) a VH comprising a VH CDR1, a VH CDR2, and a VH CDR3 having an amino acid sequence of SEQ ID NOs:4569, 4570, and 4571, respectively, and (ii) a VL comprising a VL CDR1, VL CDR2, and VL CDR3 having an amino acid sequence of SEQ ID NOs:4572, 4573, and 4574, respectively. In one aspect, provided herein is an antibody that binds CD4, comprising: (i) a VH comprising a VH CDR1, a VH CDR2, and a VH CDR3 having an amino acid sequence of SEQ ID NOs:4575, 4576, and 4577, respectively, and (ii) a VL comprising a VL CDR1, VL CDR2, and VL CDR3 having an amino acid sequence of SEQ ID NOs:4578, 4579, and 4580, respectively. In one aspect, provided herein is an antibody that binds CD4, comprising: (i) a VH comprising a VH CDR1, a VH CDR2, and a VH CDR3 having an amino acid sequence of SEQ ID NOs:4581, 4582, and 4583, respectively, and (ii) a VL comprising a VL CDR1, VL CDR2, and VL CDR3 having an amino acid sequence of SEQ ID NOs:4584, 4585, and 4586, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:4587; and (ii) a VL comprising a VL CDR1, a VL CDR2, and a VL CDR3 having an amino acid sequence of a VL CDR1, a VL CDR2, and a VL CDR3, respectively, of SEQ ID NO:4588. In one aspect, provided herein is an antibody that binds CD4, comprising a VH having an amino acid sequence of SEQ ID NO:4587. In one aspect, provided herein is an antibody that binds CD4, comprising a VL having an amino acid sequence of SEQ ID NO:4588. In one aspect, provided herein is an antibody that binds CD4, comprising a VH having an amino acid sequence of SEQ ID NO:4587, and a VL having an amino acid sequence of SEQ ID NO:4588. In one aspect, provided herein is an antibody that binds CD4, comprising a heavy chain having an amino acid sequence of SEQ ID NO:4589. In one aspect, provided herein is an antibody that binds CD4, comprising a light chain having an amino acid sequence of SEQ ID NO:4590. In one aspect, provided herein is an antibody that binds CD4, comprising a heavy chain having an amino acid sequence of SEQ ID NO:4589, and a light chain having an amino acid sequence of SEQ ID NO:4590. In one aspect, provided herein is an antibody that binds CD4, comprising a VH having an amino acid sequence having at least 95% identity to an amino acid sequence of SEQ ID NO:4587. In one aspect, provided herein is an antibody that binds CD4, comprising a VL having an amino acid sequence having at least 95% identity to an amino acid sequence of SEQ ID NO:4588. In one aspect, provided herein is an antibody that binds CD4, comprising a VH having an amino acid sequence having at least 95% identity to an amino acid sequence of SEQ ID NO:4587, and a VL having an amino acid sequence having at least 95% identity to an amino acid sequence of SEQ ID NO:4588. In one aspect, provided herein is an antibody that binds CD4, comprising a heavy chain having an amino acid sequence having at least 95% identity to an amino acid sequence of SEQ ID NO:4589. In one aspect, provided herein is an antibody that binds CD4, comprising a light chain having an amino acid sequence having at least 95% identity to an amino acid sequence of SEQ ID NO:4590. In one aspect, provided herein is an antibody that binds CD4, comprising a heavy chain having an amino acid sequence having at least 95% identity to an amino acid sequence of SEQ ID NO:4589, and a light chain having an amino acid sequence having at least 95% identity to an amino acid sequence of SEQ ID NO:4590.

In one aspect, provided herein is an antibody that binds CD4, comprising: (i) a VH comprising a VH CDR1, a VH CDR2, and a VH CDR3 having an amino acid sequence of SEQ ID NOs:4591, 4592, and 4593, respectively, and (ii) a VL comprising a VL CDR1, VL CDR2, and VL CDR3 having an amino acid sequence of SEQ ID NOs:4594, 4595, and 4596, respectively. In one aspect, provided herein is an antibody that binds CD4, comprising: (i) a VH comprising a VH CDR1, a VH CDR2, and a VH CDR3 having an amino acid sequence of SEQ ID NOs:4597, 4598, and 4599, respectively, and (ii) a VL comprising a VL CDR1, VL CDR2, and VL CDR3 having an amino acid sequence of SEQ ID NOs:4600, 4601, and 4602, respectively. In one aspect, provided herein is an antibody that binds CD4, comprising: (i) a VH comprising a VH CDR1, a VH CDR2, and a VH CDR3 having an amino acid sequence of SEQ ID NOs:4603, 4604, and 4605, respectively, and (ii) a VL comprising a VL CDR1, VL CDR2, and VL CDR3 having an amino acid sequence of SEQ ID NOs:4606, 4607, and 4608, respectively. In one aspect, provided herein is an antibody that binds CD4, comprising: (i) a VH comprising a VH CDR1, a VH CDR2, and a VH CDR3 having an amino acid sequence of SEQ ID NOs:4609, 4610, and 4611, respectively, and (ii) a VL comprising a VL CDR1, VL CDR2, and VL CDR3 having an amino acid sequence of SEQ ID NOs:4612, 4613, and 4614, respectively. In one aspect, provided herein is an antibody that binds CD4, comprising: (i) a VH comprising a VH CDR1, a VH CDR2, and a VH CDR3 having an amino acid sequence of SEQ ID NOs:4615, 4616, and 4617, respectively, and (ii) a VL comprising a VL CDR1, VL CDR2, and VL CDR3 having an amino acid sequence of SEQ ID NOs:4618, 4619, and 4620, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:4621; and (ii) a VL comprising a VL CDR1, a VL CDR2, and a VL CDR3 having an amino acid sequence of a VL CDR1, a VL CDR2, and a VL CDR3, respectively, of SEQ ID NO:4622. In one aspect, provided herein is an antibody that binds CD4, comprising a VH having an amino acid sequence of SEQ ID NO:4621. In one aspect, provided herein is an antibody that binds CD4, comprising a VL having an amino acid sequence of SEQ ID NO:4622. In one aspect, provided herein is an antibody that binds CD4, comprising a VH having an amino acid sequence of SEQ ID NO:4621, and a VL having an amino acid sequence of SEQ ID NO:4622. In one aspect, provided herein is an antibody that binds CD4, comprising a VH having an amino acid sequence having at least 95% identity to an amino acid sequence of SEQ ID NO:4621. In one aspect, provided herein is an antibody that binds CD4, comprising a VL having an amino acid sequence having at least 95% identity to an amino acid sequence of SEQ ID NO:4622. In one aspect, provided herein is an antibody that binds CD4, comprising a VH having an amino acid sequence having at least 95% identity to an amino acid sequence of SEQ ID NO:4621, and a VL having an amino acid sequence having at least 95% identity to an amino acid sequence of SEQ ID NO:4622.

In one aspect, provided herein is an antibody that binds CD4, comprising: (i) a VH comprising a VH CDR1, a VH CDR2, and a VH CDR3 having an amino acid sequence of SEQ ID NOs:4625, 4626, and 4627, respectively, and (ii) a VL comprising a VL CDR1, VL CDR2, and VL CDR3 having an amino acid sequence of SEQ ID NOs:4628, 4629, and 4630, respectively. In one aspect, provided herein is an antibody that binds CD4, comprising: (i) a VH comprising a VH CDR1, a VH CDR2, and a VH CDR3 having an amino acid sequence of SEQ ID NOs:4631, 4632, and 4633, respectively, and (ii) a VL comprising a VL CDR1, VL CDR2, and VL CDR3 having an amino acid sequence of SEQ ID NOs:4634, 4635, and 4636, respectively. In one aspect, provided herein is an antibody that binds CD4, comprising: (i) a VH comprising a VH CDR1, a VH CDR2, and a VH CDR3 having an amino acid sequence of SEQ ID NOs:4637, 4638, and 4639, respectively, and (ii) a VL comprising a VL CDR1, VL CDR2, and VL CDR3 having an amino acid sequence of SEQ ID NOs:4640, 4641, and 4642, respectively. In one aspect, provided herein is an antibody that binds CD4, comprising: (i) a VH comprising a VH CDR1, a VH CDR2, and a VH CDR3 having an amino acid sequence of SEQ ID NOs:4643, 4644, and 4645, respectively, and (ii) a VL comprising a VL CDR1, VL CDR2, and VL CDR3 having an amino acid sequence of SEQ ID NOs:4646, 4647, and 4648, respectively. In one aspect, provided herein is an antibody that binds CD4, comprising: (i) a VH comprising a VH CDR1, a VH CDR2, and a VH CDR3 having an amino acid sequence of SEQ ID NOs:4649, 4650, and 4651, respectively, and (ii) a VL comprising a VL CDR1, VL CDR2, and VL CDR3 having an amino acid sequence of SEQ ID NOs:4652, 4653, and 4654, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:4655; and (ii) a VL comprising a VL CDR1, a VL CDR2, and a VL CDR3 having an amino acid sequence of a VL CDR1, a VL CDR2, and a VL CDR3, respectively, of SEQ ID NO:4656. In one aspect, provided herein is an antibody that binds CD4, comprising a VH having an amino acid sequence of SEQ ID NO:4655. In one aspect, provided herein is an antibody that binds CD4, comprising a VL having an amino acid sequence of SEQ ID NO:4656. In one aspect, provided herein is an antibody that binds CD4, comprising a VH having an amino acid sequence of SEQ ID NO:4655, and a VL having an amino acid sequence of SEQ ID NO:4656. In one aspect, provided herein is an antibody that binds CD4, comprising a VH having an amino acid sequence having at least 95% identity to an amino acid sequence of SEQ ID NO:4655. In one aspect, provided herein is an antibody that binds CD4, comprising a VL having an amino acid sequence having at least 95% identity to an amino acid sequence of SEQ ID NO:4656. In one aspect, provided herein is an antibody that binds CD4, comprising a VH having an amino acid sequence having at least 95% identity to an amino acid sequence of SEQ ID NO:4655, and a VL having an amino acid sequence having at least 95% identity to an amino acid sequence of SEQ ID NO:4656.

In one aspect, provided herein is an antibody that binds CD4, comprising: (i) a VH comprising a VH CDR1, a VH CDR2, and a VH CDR3 having an amino acid sequence of SEQ ID NOs:4659, 4660, and 4661, respectively, and (ii) a VL comprising a VL CDR1, VL CDR2, and VL CDR3 having an amino acid sequence of SEQ ID NOs:4662, 4663, and 4664, respectively. In one aspect, provided herein is an antibody that binds CD4, comprising: (i) a VH comprising a VH CDR1, a VH CDR2, and a VH CDR3 having an amino acid sequence of SEQ ID NOs:4665, 4666, and 4667, respectively, and (ii) a VL comprising a VL CDR1, VL CDR2, and VL CDR3 having an amino acid sequence of SEQ ID NOs:4668, 4669, and 4670, respectively. In one aspect, provided herein is an antibody that binds CD4, comprising: (i) a VH comprising a VH CDR1, a VH CDR2, and a VH CDR3 having an amino acid sequence of SEQ ID NOs:4671, 4672, and 4673, respectively, and (ii) a VL comprising a VL CDR1, VL CDR2, and VL CDR3 having an amino acid sequence of SEQ ID NOs:4674, 4675, and 4676, respectively. In one aspect, provided herein is an antibody that binds CD4, comprising: (i) a VH comprising a VH CDR1, a VH CDR2, and a VH CDR3 having an amino acid sequence of SEQ ID NOs:4677, 4678, and 4679, respectively, and (ii) a VL comprising a VL CDR1, VL CDR2, and VL CDR3 having an amino acid sequence of SEQ ID NOs:4680, 4681, and 4682, respectively. In one aspect, provided herein is an antibody that binds CD4, comprising: (i) a VH comprising a VH CDR1, a VH CDR2, and a VH CDR3 having an amino acid sequence of SEQ ID NOs:4683, 4684, and 4685, respectively, and (ii) a VL comprising a VL CDR1, VL CDR2, and VL CDR3 having an amino acid sequence of SEQ ID NOs:4686, 4687, and 4688, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:4689; and (ii) a VL comprising a VL CDR1, a VL CDR2, and a VL CDR3 having an amino acid sequence of a VL CDR1, a VL CDR2, and a VL CDR3, respectively, of SEQ ID NO:4690. In one aspect, provided herein is an antibody that binds CD4, comprising a VH having an amino acid sequence of SEQ ID NO:4689. In one aspect, provided herein is an antibody that binds CD4, comprising a VL having an amino acid sequence of SEQ ID NO:4690. In one aspect, provided herein is an antibody that binds CD4, comprising a VH having an amino acid sequence of SEQ ID NO:4689, and a VL having an amino acid sequence of SEQ ID NO:4690. In one aspect, provided herein is an antibody that binds CD4, comprising a VH having an amino acid sequence having at least 95% identity to an amino acid sequence of SEQ ID NO:4689. In one aspect, provided herein is an antibody that binds CD4, comprising a VL having an amino acid sequence having at least 95% identity to an amino acid sequence of SEQ ID NO:4690. In one aspect, provided herein is an antibody that binds CD4, comprising a VH having an amino acid sequence having at least 95% identity to an amino acid sequence of SEQ ID NO:4689, and a VL having an amino acid sequence having at least 95% identity to an amino acid sequence of SEQ ID NO:4690.

In one aspect, provided herein is an antibody that binds CD4, comprising: (i) a VH comprising a VH CDR1, a VH CDR2, and a VH CDR3 having an amino acid sequence of SEQ ID NOs:4693, 4694, and 4695, respectively, and (ii) a VL comprising a VL CDR1, VL CDR2, and VL CDR3 having an amino acid sequence of SEQ ID NOs:4696, 4697, and 4698, respectively. In one aspect, provided herein is an antibody that binds CD4, comprising: (i) a VH comprising a VH CDR1, a VH CDR2, and a VH CDR3 having an amino acid sequence of SEQ ID NOs:4699, 4700, and 4701, respectively, and (ii) a VL comprising a VL CDR1, VL CDR2, and VL CDR3 having an amino acid sequence of SEQ ID NOs:4702, 4703, and 4704, respectively. In one aspect, provided herein is an antibody that binds CD4, comprising: (i) a VH comprising a VH CDR1, a VH CDR2, and a VH CDR3 having an amino acid sequence of SEQ ID NOs:4705, 4706, and 4707, respectively, and (ii) a VL comprising a VL CDR1, VL CDR2, and VL CDR3 having an amino acid sequence of SEQ ID NOs:4708, 4709, and 4710, respectively. In one aspect, provided herein is an antibody that binds CD4, comprising: (i) a VH comprising a VH CDR1, a VH CDR2, and a VH CDR3 having an amino acid sequence of SEQ ID NOs:4711, 4712, and 4713, respectively, and (ii) a VL comprising a VL CDR1, VL CDR2, and VL CDR3 having an amino acid sequence of SEQ ID NOs:4714, 4715, and 4716, respectively. In one aspect, provided herein is an antibody that binds CD4, comprising: (i) a VH comprising a VH CDR1, a VH CDR2, and a VH CDR3 having an amino acid sequence of SEQ ID NOs:4717, 4718, and 4719, respectively, and (ii) a VL comprising a VL CDR1, VL CDR2, and VL CDR3 having an amino acid sequence of SEQ ID NOs:4720, 4721, and 4722, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:4723; and (ii) a VL comprising a VL CDR1, a VL CDR2, and a VL CDR3 having an amino acid sequence of a VL CDR1, a VL CDR2, and a VL CDR3, respectively, of SEQ ID NO:4724. In one aspect, provided herein is an antibody that binds CD4, comprising a VH having an amino acid sequence of SEQ ID NO:4723. In one aspect, provided herein is an antibody that binds CD4, comprising a VL having an amino acid sequence of SEQ ID NO:4724. In one aspect, provided herein is an antibody that binds CD4, comprising a VH having an amino acid sequence of SEQ ID NO:4723, and a VL having an amino acid sequence of SEQ ID NO:4724. In one aspect, provided herein is an antibody that binds CD4, comprising a VH having an amino acid sequence having at least 95% identity to an amino acid sequence of SEQ ID NO:4723. In one aspect, provided herein is an antibody that binds CD4, comprising a VL having an amino acid sequence having at least 95% identity to an amino acid sequence of SEQ ID NO:4724. In one aspect, provided herein is an antibody that binds CD4, comprising a VH having an amino acid sequence having at least 95% identity to an amino acid sequence of SEQ ID NO:4723, and a VL having an amino acid sequence having at least 95% identity to an amino acid sequence of SEQ ID NO:4724.

In one aspect, provided herein is an antibody that binds CD4, comprising: (i) a VH comprising a VH CDR1, a VH CDR2, and a VH CDR3 having an amino acid sequence of SEQ ID NOs:4727, 4728, and 4729, respectively, and (ii) a VL comprising a VL CDR1, VL CDR2, and VL CDR3 having an amino acid sequence of SEQ ID NOs:4730, 4731, and 4732, respectively. In one aspect, provided herein is an antibody that binds CD4, comprising: (i) a VH comprising a VH CDR1, a VH CDR2, and a VH CDR3 having an amino acid sequence of SEQ ID NOs:4733, 4734, and 4735, respectively, and (ii) a VL comprising a VL CDR1, VL CDR2, and VL CDR3 having an amino acid sequence of SEQ ID NOs:4736, 4737, and 4738, respectively. In one aspect, provided herein is an antibody that binds CD4, comprising: (i) a VH comprising a VH CDR1, a VH CDR2, and a VH CDR3 having an amino acid sequence of SEQ ID NOs:4739, 4740, and 4741, respectively, and (ii) a VL comprising a VL CDR1, VL CDR2, and VL CDR3 having an amino acid sequence of SEQ ID NOs:4742, 4743, and 4744, respectively. In one aspect, provided herein is an antibody that binds CD4, comprising: (i) a VH comprising a VH CDR1, a VH CDR2, and a VH CDR3 having an amino acid sequence of SEQ ID NOs:4745, 4746, and 4747, respectively, and (ii) a VL comprising a VL CDR1, VL CDR2, and VL CDR3 having an amino acid sequence of SEQ ID NOs:4748, 4749, and 4750, respectively. In one aspect, provided herein is an antibody that binds CD4, comprising: (i) a VH comprising a VH CDR1, a VH CDR2, and a VH CDR3 having an amino acid sequence of SEQ ID NOs:4751, 4752, and 4753, respectively, and (ii) a VL comprising a VL CDR1, VL CDR2, and VL CDR3 having an amino acid sequence of SEQ ID NOs:4754, 4755, and 4756, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:4757; and (ii) a VL comprising a VL CDR1, a VL CDR2, and a VL CDR3 having an amino acid sequence of a VL CDR1, a VL CDR2, and a VL CDR3, respectively, of SEQ ID NO:4758. In one aspect, provided herein is an antibody that binds CD4, comprising a VH having an amino acid sequence of SEQ ID NO:4757. In one aspect, provided herein is an antibody that binds CD4, comprising a VL having an amino acid sequence of SEQ ID NO:4758. In one aspect, provided herein is an antibody that binds CD4, comprising a VH having an amino acid sequence of SEQ ID NO:4757, and a VL having an amino acid sequence of SEQ ID NO:4758. In one aspect, provided herein is an antibody that binds CD4, comprising a VH having an amino acid sequence having at least 95% identity to an amino acid sequence of SEQ ID NO:4757. In one aspect, provided herein is an antibody that binds CD4, comprising a VL having an amino acid sequence having at least 95% identity to an amino acid sequence of SEQ ID NO:4758. In one aspect, provided herein is an antibody that binds CD4, comprising a VH having an amino acid sequence having at least 95% identity to an amino acid sequence of SEQ ID NO:4757, and a VL having an amino acid sequence having at least 95% identity to an amino acid sequence of SEQ ID NO:4758.

In one aspect, provided herein is an antibody that binds CD4, comprising: (i) a VH comprising a VH CDR1, a VH CDR2, and a VH CDR3 having an amino acid sequence of SEQ ID NOs:4761, 4762, and 4763, respectively, and (ii) a VL comprising a VL CDR1, VL CDR2, and VL CDR3 having an amino acid sequence of SEQ ID NOs:4764, 4765, and 4766, respectively. In one aspect, provided herein is an antibody that binds CD4, comprising: (i) a VH comprising a VH CDR1, a VH CDR2, and a VH CDR3 having an amino acid sequence of SEQ ID NOs:4767, 4768, and 4769, respectively, and (ii) a VL comprising a VL CDR1, VL CDR2, and VL CDR3 having an amino acid sequence of SEQ ID NOs:4770, 4771, and 4772, respectively. In one aspect, provided herein is an antibody that binds CD4, comprising: (i) a VH comprising a VH CDR1, a VH CDR2, and a VH CDR3 having an amino acid sequence of SEQ ID NOs:4773, 4774, and 4775, respectively, and (ii) a VL comprising a VL CDR1, VL CDR2, and VL CDR3 having an amino acid sequence of SEQ ID NOs:4776, 4777, and 4778, respectively. In one aspect, provided herein is an antibody that binds CD4, comprising: (i) a VH comprising a VH CDR1, a VH CDR2, and a VH CDR3 having an amino acid sequence of SEQ ID NOs:4779, 4780, and 4781, respectively, and (ii) a VL comprising a VL CDR1, VL CDR2, and VL CDR3 having an amino acid sequence of SEQ ID NOs:4476, 4477, and 4784, respectively. In one aspect, provided herein is an antibody that binds CD4, comprising: (i) a VH comprising a VH CDR1, a VH CDR2, and a VH CDR3 having an amino acid sequence of SEQ ID NOs:4785, 4786, and 4787, respectively, and (ii) a VL comprising a VL CDR1, VL CDR2, and VL CDR3 having an amino acid sequence of SEQ ID NOs:4788, 4789, and 4790, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:4791; and (ii) a VL comprising a VL CDR1, a VL CDR2, and a VL CDR3 having an amino acid sequence of a VL CDR1, a VL CDR2, and a VL CDR3, respectively, of SEQ ID NO:4792. In one aspect, provided herein is an antibody that binds CD4, comprising a VH having an amino acid sequence of SEQ ID NO:4791. In one aspect, provided herein is an antibody that binds CD4, comprising a VL having an amino acid sequence of SEQ ID NO:4792. In one aspect, provided herein is an antibody that binds CD4, comprising a VH having an amino acid sequence of SEQ ID NO:4791, and a VL having an amino acid sequence of SEQ ID NO:4792. In one aspect, provided herein is an antibody that binds CD4, comprising a VH having an amino acid sequence having at least 95% identity to an amino acid sequence of SEQ ID NO:4791. In one aspect, provided herein is an antibody that binds CD4, comprising a VL having an amino acid sequence having at least 95% identity to an amino acid sequence of SEQ ID NO:4792. In one aspect, provided herein is an antibody that binds CD4, comprising a VH having an amino acid sequence having at least 95% identity to an amino acid sequence of SEQ ID NO:4791, and a VL having an amino acid sequence having at least 95% identity to an amino acid sequence of SEQ ID NO:4792.

In one aspect, provided herein is an antibody that binds CD4, comprising: (i) a VH comprising a VH CDR1, a VH CDR2, and a VH CDR3 having an amino acid sequence of SEQ ID NOs:4795, 4796, and 4797, respectively, and (ii) a VL comprising a VL CDR1, VL CDR2, and VL CDR3 having an amino acid sequence of SEQ ID NOs:4798, 4799, and 4800, respectively. In one aspect, provided herein is an antibody that binds CD4, comprising: (i) a VH comprising a VH CDR1, a VH CDR2, and a VH CDR3 having an amino acid sequence of SEQ ID NOs:4801, 4802, and 4803, respectively, and (ii) a VL comprising a VL CDR1, VL CDR2, and VL CDR3 having an amino acid sequence of SEQ ID NOs:4804, 4805, and 4806, respectively. In one aspect, provided herein is an antibody that binds CD4, comprising: (i) a VH comprising a VH CDR1, a VH CDR2, and a VH CDR3 having an amino acid sequence of SEQ ID NOs:4807, 4808, and 4809, respectively, and (ii) a VL comprising a VL CDR1, VL CDR2, and VL CDR3 having an amino acid sequence of SEQ ID NOs:4810, 4811, and 4812, respectively. In one aspect, provided herein is an antibody that binds CD4, comprising: (i) a VH comprising a VH CDR1, a VH CDR2, and a VH CDR3 having an amino acid sequence of SEQ ID NOs:4813, 4814, and 4815, respectively, and (ii) a VL comprising a VL CDR1, VL CDR2, and VL CDR3 having an amino acid sequence of SEQ ID NOs:4816, 4817, and 4818, respectively. In one aspect, provided herein is an antibody that binds CD4, comprising: (i) a VH comprising a VH CDR1, a VH CDR2, and a VH CDR3 having an amino acid sequence of SEQ ID NOs:4819, 4820, and 4821, respectively, and (ii) a VL comprising a VL CDR1, VL CDR2, and VL CDR3 having an amino acid sequence of SEQ ID NOs:4822, 4823, and 4824, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:4825; and (ii) a VL comprising a VL CDR1, a VL CDR2, and a VL CDR3 having an amino acid sequence of a VL CDR1, a VL CDR2, and a VL CDR3, respectively, of SEQ ID NO:4826. In one aspect, provided herein is an antibody that binds CD4, comprising a VH having an amino acid sequence of SEQ ID NO:4825. In one aspect, provided herein is an antibody that binds CD4, comprising a VL having an amino acid sequence of SEQ ID NO:4826. In one aspect, provided herein is an antibody that binds CD4, comprising a VH having an amino acid sequence of SEQ ID NO:4825, and a VL having an amino acid sequence of SEQ ID NO:4826. In one aspect, provided herein is an antibody that binds CD4, comprising a VH having an amino acid sequence having at least 95% identity to an amino acid sequence of SEQ ID NO:4825. In one aspect, provided herein is an antibody that binds CD4, comprising a VL having an amino acid sequence having at least 95% identity to an amino acid sequence of SEQ ID NO:4826. In one aspect, provided herein is an antibody that binds CD4, comprising a VH having an amino acid sequence having at least 95% identity to an amino acid sequence of SEQ ID NO:4825, and a VL having an amino acid sequence having at least 95% identity to an amino acid sequence of SEQ ID NO:4826.

In one aspect, provided herein is an antibody that binds CD4, comprising: (i) a VH comprising a VH CDR1, a VH CDR2, and a VH CDR3 having an amino acid sequence of SEQ ID NOs:4829, 4830, and 4831, respectively, and (ii) a VL comprising a VL CDR1, VL CDR2, and VL CDR3 having an amino acid sequence of SEQ ID NOs:4832, 4833, and 4834, respectively. In one aspect, provided herein is an antibody that binds CD4, comprising: (i) a VH comprising a VH CDR1, a VH CDR2, and a VH CDR3 having an amino acid sequence of SEQ ID NOs:4835, 4836, and 4837, respectively, and (ii) a VL comprising a VL CDR1, VL CDR2, and VL CDR3 having an amino acid sequence of SEQ ID NOs:4838, 4839, and 4840, respectively. In one aspect, provided herein is an antibody that binds CD4, comprising: (i) a VH comprising a VH CDR1, a VH CDR2, and a VH CDR3 having an amino acid sequence of SEQ ID NOs:4841, 4842, and 4843, respectively, and (ii) a VL comprising a VL CDR1, VL CDR2, and VL CDR3 having an amino acid sequence of SEQ ID NOs:4844, 4845, and 4846, respectively. In one aspect, provided herein is an antibody that binds CD4, comprising: (i) a VH comprising a VH CDR1, a VH CDR2, and a VH CDR3 having an amino acid sequence of SEQ ID NOs:4847, 4848, and 4849, respectively, and (ii) a VL comprising a VL CDR1, VL CDR2, and VL CDR3 having an amino acid sequence of SEQ ID NOs:4850, 4851, and 4852, respectively. In one aspect, provided herein is an antibody that binds CD4, comprising: (i) a VH comprising a VH CDR1, a VH CDR2, and a VH CDR3 having an amino acid sequence of SEQ ID NOs:4853, 4854, and 4855, respectively, and (ii) a VL comprising a VL CDR1, VL CDR2, and VL CDR3 having an amino acid sequence of SEQ ID NOs:4856, 4857, and 4858, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:4859; and (ii) a VL comprising a VL CDR1, a VL CDR2, and a VL CDR3 having an amino acid sequence of a VL CDR1, a VL CDR2, and a VL CDR3, respectively, of SEQ ID NO:4860. In one aspect, provided herein is an antibody that binds CD4, comprising a VH having an amino acid sequence of SEQ ID NO:4859. In one aspect, provided herein is an antibody that binds CD4, comprising a VL having an amino acid sequence of SEQ ID NO:4860. In one aspect, provided herein is an antibody that binds CD4, comprising a VH having an amino acid sequence of SEQ ID NO:4859, and a VL having an amino acid sequence of SEQ ID NO:4860. In one aspect, provided herein is an antibody that binds CD4, comprising a VH having an amino acid sequence having at least 95% identity to an amino acid sequence of SEQ ID NO:4859. In one aspect, provided herein is an antibody that binds CD4, comprising a VL having an amino acid sequence having at least 95% identity to an amino acid sequence of SEQ ID NO:4860. In one aspect, provided herein is an antibody that binds CD4, comprising a VH having an amino acid sequence having at least 95% identity to an amino acid sequence of SEQ ID NO:4859, and a VL having an amino acid sequence having at least 95% identity to an amino acid sequence of SEQ ID NO:4860.

In one aspect, provided herein is an antibody that binds CD4, comprising: (i) a VH comprising a VH CDR1, a VH CDR2, and a VH CDR3 having an amino acid sequence of SEQ ID NOs:4863, 4864, and 4865, respectively, and (ii) a VL comprising a VL CDR1, VL CDR2, and VL CDR3 having an amino acid sequence of SEQ ID NOs:4866, 4867, and 4868, respectively. In one aspect, provided herein is an antibody that binds CD4, comprising: (i) a VH comprising a VH CDR1, a VH CDR2, and a VH CDR3 having an amino acid sequence of SEQ ID NOs:4869, 4870, and 4871, respectively, and (ii) a VL comprising a VL CDR1, VL CDR2, and VL CDR3 having an amino acid sequence of SEQ ID NOs:4872, 4873, and 4874, respectively. In one aspect, provided herein is an antibody that binds CD4, comprising: (i) a VH comprising a VH CDR1, a VH CDR2, and a VH CDR3 having an amino acid sequence of SEQ ID NOs:4875, 4876, and 4877, respectively, and (ii) a VL comprising a VL CDR1, VL CDR2, and VL CDR3 having an amino acid sequence of SEQ ID NOs:4878, 4879, and 4880, respectively. In one aspect, provided herein is an antibody that binds CD4, comprising: (i) a VH comprising a VH CDR1, a VH CDR2, and a VH CDR3 having an amino acid sequence of SEQ ID NOs:4881, 4882, and 4883, respectively, and (ii) a VL comprising a VL CDR1, VL CDR2, and VL CDR3 having an amino acid sequence of SEQ ID NOs:4884, 4885, and 4886, respectively. In one aspect, provided herein is an antibody that binds CD4, comprising: (i) a VH comprising a VH CDR1, a VH CDR2, and a VH CDR3 having an amino acid sequence of SEQ ID NOs:4887, 4888, and 4889, respectively, and (ii) a VL comprising a VL CDR1, VL CDR2, and VL CDR3 having an amino acid sequence of SEQ ID NOs:4890, 4891, and 4892, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:4893; and (ii) a VL comprising a VL CDR1, a VL CDR2, and a VL CDR3 having an amino acid sequence of a VL CDR1, a VL CDR2, and a VL CDR3, respectively, of SEQ ID NO:4894. In one aspect, provided herein is an antibody that binds CD4, comprising a VH having an amino acid sequence of SEQ ID NO:4893. In one aspect, provided herein is an antibody that binds CD4, comprising a VL having an amino acid sequence of SEQ ID NO:4894. In one aspect, provided herein is an antibody that binds CD4, comprising a VH having an amino acid sequence of SEQ ID NO:4893, and a VL having an amino acid sequence of SEQ ID NO:4894. In one aspect, provided herein is an antibody that binds CD4, comprising a VH having an amino acid sequence having at least 95% identity to an amino acid sequence of SEQ ID NO:4893. In one aspect, provided herein is an antibody that binds CD4, comprising a VL having an amino acid sequence having at least 95% identity to an amino acid sequence of SEQ ID NO:4894. In one aspect, provided herein is an antibody that binds CD4, comprising a VH having an amino acid sequence having at least 95% identity to an amino acid sequence of SEQ ID NO:4893, and a VL having an amino acid sequence having at least 95% identity to an amino acid sequence of SEQ ID NO:4894.

In one aspect, provided herein is an antibody that binds CD4, comprising: (i) a VH comprising a VH CDR1, a VH CDR2, and a VH CDR3 having an amino acid sequence of SEQ ID NOs:4897, 4898, and 4899, respectively, and (ii) a VL comprising a VL CDR1, VL CDR2, and VL CDR3 having an amino acid sequence of SEQ ID NOs:4900, 4901, and 4902, respectively. In one aspect, provided herein is an antibody that binds CD4, comprising: (i) a VH comprising a VH CDR1, a VH CDR2, and a VH CDR3 having an amino acid sequence of SEQ ID NOs:4903, 4904, and 4905, respectively, and (ii) a VL comprising a VL CDR1, VL CDR2, and VL CDR3 having an amino acid sequence of SEQ ID NOs:4906, 4907, and 4908, respectively. In one aspect, provided herein is an antibody that binds CD4, comprising: (i) a VH comprising a VH CDR1, a VH CDR2, and a VH CDR3 having an amino acid sequence of SEQ ID NOs:4909, 4910, and 4911, respectively, and (ii) a VL comprising a VL CDR1, VL CDR2, and VL CDR3 having an amino acid sequence of SEQ ID NOs:4912, 4913, and 4914, respectively. In one aspect, provided herein is an antibody that binds CD4, comprising: (i) a VH comprising a VH CDR1, a VH CDR2, and a VH CDR3 having an amino acid sequence of SEQ ID NOs:4915, 4916, and 4917, respectively, and (ii) a VL comprising a VL CDR1, VL CDR2, and VL CDR3 having an amino acid sequence of SEQ ID NOs:4918, 4919, and 4920, respectively. In one aspect, provided herein is an antibody that binds CD4, comprising: (i) a VH comprising a VH CDR1, a VH CDR2, and a VH CDR3 having an amino acid sequence of SEQ ID NOs:4921, 4922, and 4923, respectively, and (ii) a VL comprising a VL CDR1, VL CDR2, and VL CDR3 having an amino acid sequence of SEQ ID NOs:4924, 4925, and 4926, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:4927; and (ii) a VL comprising a VL CDR1, a VL CDR2, and a VL CDR3 having an amino acid sequence of a VL CDR1, a VL CDR2, and a VL CDR3, respectively, of SEQ ID NO:4928. In one aspect, provided herein is an antibody that binds CD4, comprising a VH having an amino acid sequence of SEQ ID NO:4927. In one aspect, provided herein is an antibody that binds CD4, comprising a VL having an amino acid sequence of SEQ ID NO:4928. In one aspect, provided herein is an antibody that binds CD4, comprising a VH having an amino acid sequence of SEQ ID NO:4927, and a VL having an amino acid sequence of SEQ ID NO:4928. In one aspect, provided herein is an antibody that binds CD4, comprising a VH having an amino acid sequence having at least 95% identity to an amino acid sequence of SEQ ID NO:4927. In one aspect, provided herein is an antibody that binds CD4, comprising a VL having an amino acid sequence having at least 95% identity to an amino acid sequence of SEQ ID NO:4928. In one aspect, provided herein is an antibody that binds CD4, comprising a VH having an amino acid sequence having at least 95% identity to an amino acid sequence of SEQ ID NO:4927, and a VL having an amino acid sequence having at least 95% identity to an amino acid sequence of SEQ ID NO:4928.

In one aspect, provided herein is an antibody that binds CD4, comprising: (i) a VH comprising a VH CDR1, a VH CDR2, and a VH CDR3 having an amino acid sequence of SEQ ID NOs:4931, 4932, and 4933, respectively, and (ii) a VL comprising a VL CDR1, VL CDR2, and VL CDR3 having an amino acid sequence of SEQ ID NOs:4934, 4935, and 4936, respectively. In one aspect, provided herein is an antibody that binds CD4, comprising: (i) a VH comprising a VH CDR1, a VH CDR2, and a VH CDR3 having an amino acid sequence of SEQ ID NOs:4937, 4938, and 4939, respectively, and (ii) a VL comprising a VL CDR1, VL CDR2, and VL CDR3 having an amino acid sequence of SEQ ID NOs:4940, 4941, and 4942, respectively. In one aspect, provided herein is an antibody that binds CD4, comprising: (i) a VH comprising a VH CDR1, a VH CDR2, and a VH CDR3 having an amino acid sequence of SEQ ID NOs:4943, 4944, and 4945, respectively, and (ii) a VL comprising a VL CDR1, VL CDR2, and VL CDR3 having an amino acid sequence of SEQ ID NOs:4946, 4947, and 4948, respectively. In one aspect, provided herein is an antibody that binds CD4, comprising: (i) a VH comprising a VH CDR1, a VH CDR2, and a VH CDR3 having an amino acid sequence of SEQ ID NOs:4949, 4950, and 4951, respectively, and (ii) a VL comprising a VL CDR1, VL CDR2, and VL CDR3 having an amino acid sequence of SEQ ID NOs:4952, 4953, and 4954, respectively. In one aspect, provided herein is an antibody that binds CD4, comprising: (i) a VH comprising a VH CDR1, a VH CDR2, and a VH CDR3 having an amino acid sequence of SEQ ID NOs:4955, 4956, and 4957, respectively, and (ii) a VL comprising a VL CDR1, VL CDR2, and VL CDR3 having an amino acid sequence of SEQ ID NOs:4958, 4959, and 4960, respectively. In one aspect, provided herein is an antibody that binds CD4, comprising: (i) a VH comprising a VH CDR1, a VH CDR2, and a VH CDR3 having an amino acid sequence of a VH CDR1, a VH CDR2, and a VH CDR3, respectively, of SEQ ID NO:4961; and (ii) a VL comprising a VL CDR1, a VL CDR2, and a VL CDR3 having an amino acid sequence of a VL CDR1, a VL CDR2, and a VL CDR3, respectively, of SEQ ID NO:4962. In one aspect, provided herein is an antibody that binds CD4, comprising a VH having an amino acid sequence of SEQ ID NO:4961. In one aspect, provided herein is an antibody that binds CD4, comprising a VL having an amino acid sequence of SEQ ID NO:4962. In one aspect, provided herein is an antibody that binds CD4, comprising a VH having an amino acid sequence of SEQ ID NO:4961, and a VL having an amino acid sequence of SEQ ID NO:4962. In one aspect, provided herein is an antibody that binds CD4, comprising a VH having an amino acid sequence having at least 95% identity to an amino acid sequence of SEQ ID NO:4961. In one aspect, provided herein is an antibody that binds CD4, comprising a VL having an amino acid sequence having at least 95% identity to an amino acid sequence of SEQ ID NO:4962. In one aspect, provided herein is an antibody that binds CD4, comprising a VH having an amino acid sequence having at least 95% identity to an amino acid sequence of SEQ ID NO:4961, and a VL having an amino acid sequence having at least 95% identity to an amino acid sequence of SEQ ID NO:4962.

In one aspect, provided herein is an antibody that binds CD4 comprising a VH CDR1 having an amino acid sequence of SEQ ID NO:2201, wherein the sixth amino acid is D or S; a VH CDR2 having an amino acid sequence of SEQ ID NO:2202, wherein the first amino acid is I or T, the second amino acid is N or K, the third amino acid is E or Q, the fourth amino acid is D or E, the sixth amino acid is G, N or S, and the seventh amino acid is D or E; and a VH CDR3 having an amino acid sequence of SEQ ID NO:2203, wherein the first amino acid is A or V, the ninth amino acid is A or S, and the twelfth amino acid is H or Y. In one aspect, provided herein is an antibody that binds CD4 comprising a VL CDR1 having an amino acid sequence of SEQ ID NO:2204, wherein the fourth amino acid is R or S; a VL CDR2 having an amino acid sequence of SEQ ID NO:2205, wherein the first amino acid is A or G, and the second amino acid is A or V; and a VL CDR3 having an amino acid sequence of SEQ ID NO:2206. In one aspect, provided herein is an antibody that binds CD4 comprising a VH CDR1 having an amino acid sequence of SEQ ID NO:2201, wherein the sixth amino acid is D or S; a VH CDR2 having an amino acid sequence of SEQ ID NO:2202, wherein the first amino acid is I or T, the second amino acid is N or K, the third amino acid is E or Q, the fourth amino acid is D or E, the sixth amino acid is G, N or S, and the seventh amino acid is D or E; a VH CDR3 having an amino acid sequence of SEQ ID NO:2203, wherein the first amino acid is A or V, the ninth amino acid is A or S, and the twelfth amino acid is H or Y; a VL CDR1 having an amino acid sequence of SEQ ID NO:2204, wherein the fourth amino acid is R or S; a VL CDR2 having an amino acid sequence of SEQ ID NO:2205, wherein the first amino acid is A or G, and the second amino acid is A or V; and a VL CDR3 having an amino acid sequence of SEQ ID NO:2206.

In one aspect, provided herein is an antibody that binds CD4 comprising a VH CDR1 having an amino acid sequence of SEQ ID NO:2235, wherein the first amino acid is G or N, the fifth amino acid is I or S, the sixth amino acid is D, N, S or T, and the seventh amino acid is F or Y; a VH CDR2 having an amino acid sequence of SEQ ID NO:2236, wherein the second amino acid is N or Y, and the third amino acid is S or T; and a VH CDR3 having an amino acid sequence of SEQ ID NO:2237, wherein the third amino acid is D or E, the fourth amino acid is L or R, the sixth amino acid is A, D, K, or R, the seventh amino acid is R or Y, the eighth amino acid is L, N, or Y, the ninth amino acid is F or Y, and the twelfth amino acid is L, M, or V. In one aspect, provided herein is an antibody that binds CD4 comprising a VL CDR1 having an amino acid sequence of SEQ ID NO:2238, wherein the first amino acid is H or Q, the second amino acid is D or G, and the fourth amino acid is G. T or S; a VL CDR2 having an amino acid sequence of SEQ ID NO:2239, wherein the first amino acid is A, D, V or Y, and the second amino acid is A or T; and a VL CDR3 having an amino acid sequence of SEQ ID NO:2240, wherein the first amino acid is L or Q, the third amino acid is H or Y, the fourth amino acid is D or N, the fifth amino acid is H, N, or S, and the sixth amino acid is L or Y. In one aspect, provided herein is an antibody that binds CD4 comprising a VH CDR1 having an amino acid sequence of SEQ ID NO:2235, wherein the first amino acid is G or N, the fifth amino acid is I or S, the sixth amino acid is D, N, S or T, and the seventh amino acid is F or Y; a VH CDR2 having an amino acid sequence of SEQ ID NO:2236, wherein the second amino acid is N or Y, and the third amino acid is S or T; a VH CDR3 having an amino acid sequence of SEQ ID NO:2237, wherein the third amino acid is D or E, the fourth amino acid is L or R, the sixth amino acid is A, D, K, or R, the seventh amino acid is R or Y, the eighth amino acid is L, N, or Y, the ninth amino acid is F or Y, and the twelfth amino acid is L, M, or V; a VL CDR1 having an amino acid sequence of SEQ ID NO:2238, wherein the first amino acid is H or Q, the second amino acid is D or G, and the fourth amino acid is G. T or S; a VL CDR2 having an amino acid sequence of SEQ ID NO:2239, wherein the first amino acid is A, D, V or Y, and the second amino acid is A or T; and a VL CDR3 having an amino acid sequence of SEQ ID NO:2240, wherein the first amino acid is L or Q, the third amino acid is H or Y, the fourth amino acid is D or N, the fifth amino acid is H, N, or S, and the sixth amino acid is L or Y.

In one aspect, provided herein is an antibody that binds CD4 comprising a VH CDR1 having an amino acid sequence of SEQ ID NO:2303, wherein the fourth amino acid is F or L; a VH CDR2 having an amino acid sequence of SEQ ID NO:2304, wherein the third amino acid is H or Q, and the sixth amino acid is S or T; and a VH CDR3 having an amino acid sequence of SEQ ID NO:2305, wherein the first amino acid is A, T, or V, the third amino acid is E, L, or V, the fourth amino acid is I, L, or V, and the ninth amino acid is P or S. In one aspect, provided herein is an antibody that binds CD4 comprising a VL CDR1 having an amino acid sequence of SEQ ID NO:2306, wherein the second amino acid is D or G, the fourth amino acid is A or S, and the fifth amino acid is D, N, or S; a VL CDR2 having an amino acid sequence of SEQ ID NO:2307, wherein the first amino acid is A or D; and a VL CDR3 having an amino acid sequence of SEQ ID NO:2308, wherein the ninth amino acid is S or T. In one aspect, provided herein is an antibody that binds CD4 comprising a VH CDR1 having an amino acid sequence of SEQ ID NO:2303, wherein the fourth amino acid is F or L; a VH CDR2 having an amino acid sequence of SEQ ID NO:2304, wherein the third amino acid is H or Q, and the sixth amino acid is S or T; a VH CDR3 having an amino acid sequence of SEQ ID NO:2305, wherein the first amino acid is A, T, or V, the third amino acid is E, L, or V, the fourth amino acid is I, L, or V, and the ninth amino acid is P or S; a VL CDR1 having an amino acid sequence of SEQ ID NO:2306, wherein the second amino acid is D or G, the fourth amino acid is A or S, and the fifth amino acid is D, N, or S; a VL CDR2 having an amino acid sequence of SEQ ID NO:2307, wherein the first amino acid is A or D; and a VL CDR3 having an amino acid sequence of SEQ ID NO:2308, wherein the ninth amino acid is S or T.

In one aspect, provided herein is an antibody that binds CD4 comprising a VH CDR1 having an amino acid sequence of SEQ ID NO:2337, wherein the fifth amino acid is N, R or S, and the sixth amino acid is N or S; a VH CDR2 having an amino acid sequence of SEQ ID NO:2338, wherein the fifth amino acid is D or G; and a VH CDR3 having an amino acid sequence of SEQ ID NO:2339, wherein the fourth amino acid is A, D, G or N, the fifth amino acid is D, F, L or Y, the sixth amino acid is D, S, F or Y, and the tenth amino acid is L or M. In one aspect, provided herein is an antibody that binds CD4 comprising a VL CDR1 having an amino acid sequence of SEQ ID NO:2340, wherein the second amino acid is N or S, the third amino acid is F, I, L, T or V, the fourth amino acid is I, S, T or Y, and the fifth amino acid is I, N, or S; a VL CDR2 having an amino acid sequence of SEQ ID NO:2341; and a VL CDR3 having an amino acid sequence of SEQ ID NO:2342, wherein the first amino acid is H or Q, the third amino acid is F, H, S or Y, and the fifth amino acid is F, I, N, S or T. In one aspect, provided herein is an antibody that binds CD4 comprising a VH CDR1 having an amino acid sequence of SEQ ID NO:2337, wherein the fifth amino acid is N, R or S, and the sixth amino acid is N or S; a VH CDR2 having an amino acid sequence of SEQ ID NO:2338, wherein the fifth amino acid is D or G; a VH CDR3 having an amino acid sequence of SEQ ID NO:2339, wherein the fourth amino acid is A, D, G or N, the fifth amino acid is D, F, L or Y, the sixth amino acid is D, S, F or Y, and the tenth amino acid is L or M; a VL CDR1 having an amino acid sequence of SEQ ID NO:2340, wherein the second amino acid is N or S, the third amino acid is F, I, L, T or V, the fourth amino acid is I, S, T or Y, and the fifth amino acid is I, N, or S; a VL CDR2 having an amino acid sequence of SEQ ID NO:2341; and a VL CDR3 having an amino acid sequence of SEQ ID NO:2342, wherein the first amino acid is H or Q, the third amino acid is F, H, S or Y, and the fifth amino acid is F, I, N, S or T.

In one aspect, provided herein is an antibody that binds CD4 comprising a VH CDR1 having an amino acid sequence of SEQ ID NO:2745, wherein the second amino acid is D or G; a VH CDR2 having an amino acid sequence of SEQ ID NO:2746, wherein the sixth amino acid is N or S; and a VH CDR3 having an amino acid sequence of SEQ ID NO:2747. In one aspect, provided herein is an antibody that binds CD4 comprising a VL CDR1 having an amino acid sequence of SEQ ID NO:2748, wherein the fourth amino acid is G or S, the fifth amino acid is S or T, and the sixth amino acid is S or T; a VL CDR2 having an amino acid sequence of SEQ ID NO:2749, wherein the third amino acid is F or S; and a VL CDR3 having an amino acid sequence of SEQ ID NO:2750, wherein the fifth amino acid is R or S. In one aspect, provided herein is an antibody that binds CD4 comprising a VH CDR1 having an amino acid sequence of SEQ ID NO:2745, wherein the second amino acid is D or G; a VH CDR2 having an amino acid sequence of SEQ ID NO:2746, wherein the sixth amino acid is N or S; a VH CDR3 having an amino acid sequence of SEQ ID NO:2747; a VL CDR1 having an amino acid sequence of SEQ ID NO:2748, wherein the fourth amino acid is G or S, the fifth amino acid is S or T, and the sixth amino acid is S or T; a VL CDR2 having an amino acid sequence of SEQ ID NO:2749, wherein the third amino acid is F or S; and a VL CDR3 having an amino acid sequence of SEQ ID NO:2750, wherein the fifth amino acid is R or S.

In one aspect, provided herein is an antibody that binds CD4 comprising a VH CDR1 having an amino acid sequence of SEQ ID NO:2949, wherein the second amino acid is G or V, the fourth amino acid is I or S, and the seventh amino acid is F or Y, wherein the second amino acid is G or V, the fourth amino acid is I or S, and the seventh amino acid is F or Y; a VH CDR2 having an amino acid sequence of SEQ ID NO:2950; and a VH CDR3 having an amino acid sequence of SEQ ID NO:2951, wherein the eleventh amino acid is A or N. In one aspect, provided herein is an antibody that binds CD4 comprising a VL CDR1 having an amino acid sequence of SEQ ID NO:2952; a VL CDR2 having an amino acid sequence of SEQ ID NO:2953, wherein the second amino acid is A or T; and a VL CDR3 having an amino acid sequence of SEQ ID NO:2954, wherein the third amino acid is C or Y. In one aspect, provided herein is an antibody that binds CD4 comprising a VH CDR1 having an amino acid sequence of SEQ ID NO:2949, wherein the second amino acid is G or V, the fourth amino acid is I or S, and the seventh amino acid is F or Y, wherein the second amino acid is G or V, the fourth amino acid is I or S, and the seventh amino acid is F or Y; a VH CDR2 having an amino acid sequence of SEQ ID NO:2950; a VH CDR3 having an amino acid sequence of SEQ ID NO:2951, wherein the eleventh amino acid is A or N; a VL CDR1 having an amino acid sequence of SEQ ID NO:2952; a VL CDR2 having an amino acid sequence of SEQ ID NO:2953, wherein the second amino acid is A or T; and a VL CDR3 having an amino acid sequence of SEQ ID NO:2954, wherein the third amino acid is C or Y.

In one aspect, provided herein is an antibody that binds CD4 comprising a VH CDR1 having an amino acid sequence of SEQ ID NO:3187, wherein the first amino acid is N or G, and the sixth amino acid is R, S, or T; a VH CDR2 having an amino acid sequence of SEQ ID NO:3188, wherein the second amino acid is C or Y, the fifth amino acid is E or G, the sixth amino acid is N, R or S, and the seventh amino acid is P or T; a VH CDR3 having an amino acid sequence of SEQ ID NO:3189, wherein the third amino acid is D or E, the fourth amino acid is L or R, the sixth amino acid is D or R, the seventh amino acid is L, P or Y, and the eighth amino acid is N or Y. In one aspect, provided herein is an antibody that binds CD4 comprising a VL CDR1 having an amino acid sequence of SEQ ID NO:3190, wherein the first amino acid is H or Q; a VL CDR2 having an amino acid sequence of SEQ ID NO:3191, wherein the first amino acid is D or Y; and a VL CDR3 having an amino acid sequence of SEQ ID NO:3192, wherein the fifth amino acid is N or T, and the eighth amino acid is I or L. In one aspect, provided herein is an antibody that binds CD4 comprising a VH CDR1 having an amino acid sequence of SEQ ID NO:3187, wherein the first amino acid is N or G, and the sixth amino acid is R, S, or T; a VH CDR2 having an amino acid sequence of SEQ ID NO:3188, wherein the second amino acid is C or Y, the fifth amino acid is E or G, the sixth amino acid is N, R or S, and the seventh amino acid is P or T; a VH CDR3 having an amino acid sequence of SEQ ID NO:3189, wherein the third amino acid is D or E, the fourth amino acid is L or R, the sixth amino acid is D or R, the seventh amino acid is L, P or Y, and the eighth amino acid is N or Y; a VL CDR1 having an amino acid sequence of SEQ ID NO:3190, wherein the first amino acid is H or Q; a VL CDR2 having an amino acid sequence of SEQ ID NO:3191, wherein the first amino acid is D or Y; and a VL CDR3 having an amino acid sequence of SEQ ID NO:3192, wherein the fifth amino acid is N or T, and the eighth amino acid is I or L.

In one aspect, provided herein is an antibody that binds CD4 comprising a VH CDR1 having an amino acid sequence of SEQ ID NO:3663, wherein the sixth amino acid is G, N, S or T, the seventh amino acid is F or Y, and the eighth amino acid is F or Y; a VH CDR2 having an amino acid sequence of SEQ ID NO:3664, wherein the second amino acid is C or Y, the third amino acid is A, I, S or T, the fourth amino acid is S or T, the fifth amino acid is E or G, and the sixth amino acid is N or S; and a VH CDR3 having an amino acid sequence of SEQ ID NO:3665, wherein the third amino acid is D or E, the fourth amino acid is L or R, the sixth amino acid is D, G, or R, the seventh amino acid is L, P, or Y, and the eighth amino acid is N or Y. In one aspect, provided herein is an antibody that binds CD4 comprising a VL CDR1 having an amino acid sequence of SEQ ID NO:3666, wherein the fifth amino acid is K or N; a VL CDR2 having an amino acid sequence of SEQ ID NO:3667, wherein the first amino acid is A, D, G or N; and a VL CDR3 having an amino acid sequence of SEQ ID NO:3668, wherein the fifth amino acid is N or S, and the eighth amino acid is I or L. In one aspect, provided herein is an antibody that binds CD4 comprising a VH CDR1 having an amino acid sequence of SEQ ID NO:3663, wherein the sixth amino acid is G, N, S or T, the seventh amino acid is F or Y, and the eighth amino acid is F or Y; a VH CDR2 having an amino acid sequence of SEQ ID NO:3664, wherein the second amino acid is C or Y, the third amino acid is A, I, S or T, the fourth amino acid is S or T, the fifth amino acid is E or G, and the sixth amino acid is N or S; a VH CDR3 having an amino acid sequence of SEQ ID NO:3665, wherein the third amino acid is D or E, the fourth amino acid is L or R, the sixth amino acid is D, G, or R, the seventh amino acid is L, P, or Y, and the eighth amino acid is N or Y; a VL CDR1 having an amino acid sequence of SEQ ID NO:3666, wherein the fifth amino acid is K or N; a VL CDR2 having an amino acid sequence of SEQ ID NO:3667, wherein the first amino acid is A, D, G or N; and a VL CDR3 having an amino acid sequence of SEQ ID NO:3668, wherein the fifth amino acid is N or S, and the eighth amino acid is I or L.

In one aspect, provided herein is an antibody that binds CD4 comprising a VH CDR1 having an amino acid sequence of SEQ ID NO:3221, wherein the sixth amino acid is D or S; a VH CDR2 having an amino acid sequence of SEQ ID NO:3222, wherein the eighth amino acid is K or deleted; and a VH CDR3 having an amino acid sequence of SEQ ID NO:3223, wherein the ninth amino acid is A or S. In one aspect, provided herein is an antibody that binds CD4 comprising a VL CDR1 having an amino acid sequence of SEQ ID NO:3224; a VL CDR2 having an amino acid sequence of SEQ ID NO:3225, wherein the second amino acid is A or V; and a VL CDR3 having an amino acid sequence of SEQ ID NO:3226, wherein the fifth amino acid is I or S. In one aspect, provided herein is an antibody that binds CD4 comprising a VH CDR1 having an amino acid sequence of SEQ ID NO:3221, wherein the sixth amino acid is D or S; a VH CDR2 having an amino acid sequence of SEQ ID NO:3222, wherein the eighth amino acid is K or deleted; a VH CDR3 having an amino acid sequence of SEQ ID NO:3223, wherein the ninth amino acid is A or S; a VL CDR1 having an amino acid sequence of SEQ ID NO:3224; a VL CDR2 having an amino acid sequence of SEQ ID NO:3225, wherein the second amino acid is A or V; and a VL CDR3 having an amino acid sequence of SEQ ID NO:3226, wherein the fifth amino acid is I or S.

In one aspect, provided herein is an antibody that binds CD4 comprising a VH CDR1 having an amino acid sequence of SEQ ID NO:3391, wherein the second amino acid is D or G, and the fifth amino acid is G, R or S; a VH CDR2 having an amino acid sequence of SEQ ID NO:3392, wherein the third amino acid is A or T, and the sixth amino acid is R or S; and a VH CDR3 having an amino acid sequence of SEQ ID NO:3393, wherein the second amino acid is R or T, the fourth amino acid is E or G, the sixth amino acid is P or V, the seventh amino acid is G or T, the ninth amino acid is A or S, the tenth amino acid is L or F, and the twelfth amino acid is I or Y. In one aspect, provided herein is an antibody that binds CD4 comprising a VL CDR1 having an amino acid sequence of SEQ ID NO:3394; a VL CDR2 having an amino acid sequence of SEQ ID NO:3395; and a VL CDR3 having an amino acid sequence of SEQ ID NO:3396, wherein the third amino acid is H or R. In one aspect, provided herein is an antibody that binds CD4 comprising a VH CDR1 having an amino acid sequence of SEQ ID NO:3391, wherein the second amino acid is D or G, and the fifth amino acid is G, R or S; a VH CDR2 having an amino acid sequence of SEQ ID NO:3392, wherein the third amino acid is A or T, and the sixth amino acid is R or S; a VH CDR3 having an amino acid sequence of SEQ ID NO:3393, wherein the second amino acid is R or T, the fourth amino acid is E or G, the sixth amino acid is P or V, the seventh amino acid is G or T, the ninth amino acid is A or S, the tenth amino acid is L or F, and the twelfth amino acid is I or Y; a VL CDR1 having an amino acid sequence of SEQ ID NO:3394; a VL CDR2 having an amino acid sequence of SEQ ID NO:3395; and a VL CDR3 having an amino acid sequence of SEQ ID NO:3396, wherein the third amino acid is H or R.

In one aspect, provided herein is an antibody that binds CD4 comprising a VH CDR1 having an amino acid sequence of SEQ ID NO:3867, wherein the third amino acid is I or T; a VH CDR2 having an amino acid sequence of SEQ ID NO:3868, wherein the third amino acid is E or Q; and a VH CDR3 having an amino acid sequence of SEQ ID NO:3869, wherein the fourth amino acid is G or N, the seventh amino acid is S or Y, and the eighth amino acid is G or Y. In one aspect, provided herein is an antibody that binds CD4 comprising a VL CDR1 having an amino acid sequence of SEQ ID NO:3870, wherein the fifth amino acid is N or D; a VL CDR2 having an amino acid sequence of SEQ ID NO:3871; and a VL CDR3 having an amino acid sequence of SEQ ID NO:3872, wherein the second amino acid is H or L, and the third amino acid is D or H. In one aspect, provided herein is an antibody that binds CD4 comprising a VH CDR1 having an amino acid sequence of SEQ ID NO:3867, wherein the third amino acid is I or T; a VH CDR2 having an amino acid sequence of SEQ ID NO:3868, wherein the third amino acid is E or Q; a VH CDR3 having an amino acid sequence of SEQ ID NO:3869, wherein the fourth amino acid is G or N, the seventh amino acid is S or Y, and the eighth amino acid is G or Y; a VL CDR1 having an amino acid sequence of SEQ ID NO:3870, wherein the fifth amino acid is N or D; a VL CDR2 having an amino acid sequence of SEQ ID NO:3871; and a VL CDR3 having an amino acid sequence of SEQ ID NO:3872, wherein the second amino acid is H or L, and the third amino acid is D or H.

In one aspect, provided herein is an antibody that binds CD4 comprising a VH CDR1 having an amino acid sequence of SEQ ID NO:4581; a VH CDR2 having an amino acid sequence of SEQ ID NO:4582, wherein the third amino acid is H or Q, and the sixth amino acid is N or S; and a VH CDR3 having an amino acid sequence of SEQ ID NO:4583, wherein the sixth amino acid is F, W or Y. In one aspect, provided herein is an antibody that binds CD4 comprising a VL CDR1 having an amino acid sequence of SEQ ID NO:4584, wherein the first amino acid is P or Q, the second amino acid is D or G, the fourth amino acid is A or S, and the fifth amino acid is D or N; a VL CDR2 having an amino acid sequence of SEQ ID NO:4585; and a VL CDR3 having an amino acid sequence of SEQ ID NO:4586, wherein the eight amino acid is L or Y. In one aspect, provided herein is an antibody that binds CD4 comprising a VH CDR1 having an amino acid sequence of SEQ ID NO:4581; a VH CDR2 having an amino acid sequence of SEQ ID NO:4582, wherein the third amino acid is H or Q, and the sixth amino acid is N or S; a VH CDR3 having an amino acid sequence of SEQ ID NO:4583, wherein the sixth amino acid is F, W or Y; a VL CDR1 having an amino acid sequence of SEQ ID NO:4584, wherein the first amino acid is P or Q, the second amino acid is D or G, the fourth amino acid is A or S, and the fifth amino acid is D or N; a VL CDR2 having an amino acid sequence of SEQ ID NO:4585; and a VL CDR3 having an amino acid sequence of SEQ ID NO:4586, wherein the eight amino acid is L or Y.

In another aspect, provided herein is an antibody that competes for binding to CD4 with any of the CD4 antibodies described herein. In another aspect, provided herein is an antibody that binds to the same epitope as any of the CD4 antibodies described herein. In another aspect, provided is a CD4 antibody that binds an epitope on CD4 that overlaps with the epitope on CD4 bound by a CD4 antibody described herein.

In one aspect, provided is an antibody that competes for binding to CD4 with a CD4 reference antibody. In another aspect, provided is a CD4 antibody that binds to the same CD4 epitope as a CD4 reference antibody. In another aspect, provided is a CD4 antibody that binds an epitope on CD4 that overlaps with the epitope on CD4 bound by a CD4 reference antibody. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:2207; and (ii) a VL comprising a VL CDR1, a VL CDR2, and a VL CDR3 having an amino acid sequence of a VL CDR1, a VL CDR2, and a VL CDR3, respectively, of SEQ ID NO:2208. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:2241; and (ii) a VL comprising a VL CDR1, a VL CDR2, and a VL CDR3 having an amino acid sequence of a VL CDR1, a VL CDR2, and a VL CDR3, respectively, of SEQ ID NO:2242. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:2275; and (ii) a VL comprising a VL CDR1, a VL CDR2, and a VL CDR3 having an amino acid sequence of a VL CDR1, a VL CDR2, and a VL CDR3, respectively, of SEQ ID NO:2276. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:2309; and (ii) a VL comprising a VL CDR1, a VL CDR2, and a VL CDR3 having an amino acid sequence of a VL CDR1, a VL CDR2, and a VL CDR3, respectively, of SEQ ID NO:2310. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:2343; and (ii) a VL comprising a VL CDR1, a VL CDR2, and a VL CDR3 having an amino acid sequence of a VL CDR1, a VL CDR2, and a VL CDR3, respectively, of SEQ ID NO:2344. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:2377; and (ii) a VL comprising a VL CDR1, a VL CDR2, and a VL CDR3 having an amino acid sequence of a VL CDR1, a VL CDR2, and a VL CDR3, respectively, of SEQ ID NO:2378. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:2411; and (ii) a VL comprising a VL CDR1, a VL CDR2, and a VL CDR3 having an amino acid sequence of a VL CDR1, a VL CDR2, and a VL CDR3, respectively, of SEQ ID NO:2412. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:2445; and (ii) a VL comprising a VL CDR1, a VL CDR2, and a VL CDR3 having an amino acid sequence of a VL CDR1, a VL CDR2, and a VL CDR3, respectively, of SEQ ID NO:2446. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:2479; and (ii) a VL comprising a VL CDR1, a VL CDR2, and a VL CDR3 having an amino acid sequence of a VL CDR1, a VL CDR2, and a VL CDR3, respectively, of SEQ ID NO:2480. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:2513; and (ii) a VL comprising a VL CDR1, a VL CDR2, and a VL CDR3 having an amino acid sequence of a VL CDR1, a VL CDR2, and a VL CDR3, respectively, of SEQ ID NO:2514. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:2547; and (ii) a VL comprising a VL CDR1, a VL CDR2, and a VL CDR3 having an amino acid sequence of a VL CDR1, a VL CDR2, and a VL CDR3, respectively, of SEQ ID NO:2548. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:2581; and (ii) a VL comprising a VL CDR1, a VL CDR2, and a VL CDR3 having an amino acid sequence of a VL CDR1, a VL CDR2, and a VL CDR3, respectively, of SEQ ID NO:2582. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:2615; and (ii) a VL comprising a VL CDR1, a VL CDR2, and a VL CDR3 having an amino acid sequence of a VL CDR1, a VL CDR2, and a VL CDR3, respectively, of SEQ ID NO:2616. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:2649; and (ii) a VL comprising a VL CDR1, a VL CDR2, and a VL CDR3 having an amino acid sequence of a VL CDR1, a VL CDR2, and a VL CDR3, respectively, of SEQ ID NO:2650. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:2683; and (ii) a VL comprising a VL CDR1, a VL CDR2, and a VL CDR3 having an amino acid sequence of a VL CDR1, a VL CDR2, and a VL CDR3, respectively, of SEQ ID NO:2684. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:2717; and (ii) a VL comprising a VL CDR1, a VL CDR2, and a VL CDR3 having an amino acid sequence of a VL CDR1, a VL CDR2, and a VL CDR3, respectively, of SEQ ID NO:2718. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:2751; and (ii) a VL comprising a VL CDR1, a VL CDR2, and a VL CDR3 having an amino acid sequence of a VL CDR1, a VL CDR2, and a VL CDR3, respectively, of SEQ ID NO:2752. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:2785; and (ii) a VL comprising a VL CDR1, a VL CDR2, and a VL CDR3 having an amino acid sequence of a VL CDR1, a VL CDR2, and a VL CDR3, respectively, of SEQ ID NO:2786. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:2819; and (ii) a VL comprising a VL CDR1, a VL CDR2, and a VL CDR3 having an amino acid sequence of a VL CDR1, a VL CDR2, and a VL CDR3, respectively, of SEQ ID NO:2820. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:2853; and (ii) a VL comprising a VL CDR1, a VL CDR2, and a VL CDR3 having an amino acid sequence of a VL CDR1, a VL CDR2, and a VL CDR3, respectively, of SEQ ID NO:2854. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:2887; and (ii) a VL comprising a VL CDR1, a VL CDR2, and a VL CDR3 having an amino acid sequence of a VL CDR1, a VL CDR2, and a VL CDR3, respectively, of SEQ ID NO:2888. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:2921; and (ii) a VL comprising a VL CDR1, a VL CDR2, and a VL CDR3 having an amino acid sequence of a VL CDR1, a VL CDR2, and a VL CDR3, respectively, of SEQ ID NO:2922. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:2955; and (ii) a VL comprising a VL CDR1, a VL CDR2, and a VL CDR3 having an amino acid sequence of a VL CDR1, a VL CDR2, and a VL CDR3, respectively, of SEQ ID NO:2956. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:2989; and (ii) a VL comprising a VL CDR1, a VL CDR2, and a VL CDR3 having an amino acid sequence of a VL CDR1, a VL CDR2, and a VL CDR3, respectively, of SEQ ID NO:2990. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:3023; and (ii) a VL comprising a VL CDR1, a VL CDR2, and a VL CDR3 having an amino acid sequence of a VL CDR1, a VL CDR2, and a VL CDR3, respectively, of SEQ ID NO:3024. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:3057; and (ii) a VL comprising a VL CDR1, a VL CDR2, and a VL CDR3 having an amino acid sequence of a VL CDR1, a VL CDR2, and a VL CDR3, respectively, of SEQ ID NO:3058. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:3091; and (ii) a VL comprising a VL CDR1, a VL CDR2, and a VL CDR3 having an amino acid sequence of a VL CDR1, a VL CDR2, and a VL CDR3, respectively, of SEQ ID NO:3092. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:3125; and (ii) a VL comprising a VL CDR1, a VL CDR2, and a VL CDR3 having an amino acid sequence of a VL CDR1, a VL CDR2, and a VL CDR3, respectively, of SEQ ID NO:3126. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:3159; and (ii) a VL comprising a VL CDR1, a VL CDR2, and a VL CDR3 having an amino acid sequence of a VL CDR1, a VL CDR2, and a VL CDR3, respectively, of SEQ ID NO:3160. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:3193; and (ii) a VL comprising a VL CDR1, a VL CDR2, and a VL CDR3 having an amino acid sequence of a VL CDR1, a VL CDR2, and a VL CDR3, respectively, of SEQ ID NO:3194. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:3227; and (ii) a VL comprising a VL CDR1, a VL CDR2, and a VL CDR3 having an amino acid sequence of a VL CDR1, a VL CDR2, and a VL CDR3, respectively, of SEQ ID NO:3228. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:3261; and (ii) a VL comprising a VL CDR1, a VL CDR2, and a VL CDR3 having an amino acid sequence of a VL CDR1, a VL CDR2, and a VL CDR3, respectively, of SEQ ID NO:3262. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:3295; and (ii) a VL comprising a VL CDR1, a VL CDR2, and a VL CDR3 having an amino acid sequence of a VL CDR1, a VL CDR2, and a VL CDR3, respectively, of SEQ ID NO:3296. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:3329; and (ii) a VL comprising a VL CDR1, a VL CDR2, and a VL CDR3 having an amino acid sequence of a VL CDR1, a VL CDR2, and a VL CDR3, respectively, of SEQ ID NO:3330. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:3363; and (ii) a VL comprising a VL CDR1, a VL CDR2, and a VL CDR3 having an amino acid sequence of a VL CDR1, a VL CDR2, and a VL CDR3, respectively, of SEQ ID NO:3364. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:3397; and (ii) a VL comprising a VL CDR1, a VL CDR2, and a VL CDR3 having an amino acid sequence of a VL CDR1, a VL CDR2, and a VL CDR3, respectively, of SEQ ID NO:3398. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:3431; and (ii) a VL comprising a VL CDR1, a VL CDR2, and a VL CDR3 having an amino acid sequence of a VL CDR1, a VL CDR2, and a VL CDR3, respectively, of SEQ ID NO:3432. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:3465; and (ii) a VL comprising a VL CDR1, a VL CDR2, and a VL CDR3 having an amino acid sequence of a VL CDR1, a VL CDR2, and a VL CDR3, respectively, of SEQ ID NO:3466. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:3499; and (ii) a VL comprising a VL CDR1, a VL CDR2, and a VL CDR3 having an amino acid sequence of a VL CDR1, a VL CDR2, and a VL CDR3, respectively, of SEQ ID NO:3500. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:3533; and (ii) a VL comprising a VL CDR1, a VL CDR2, and a VL CDR3 having an amino acid sequence of a VL CDR1, a VL CDR2, and a VL CDR3, respectively, of SEQ ID NO:3534. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:3567; and (ii) a VL comprising a VL CDR1, a VL CDR2, and a VL CDR3 having an amino acid sequence of a VL CDR1, a VL CDR2, and a VL CDR3, respectively, of SEQ ID NO:3568. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:3601; and (ii) a VL comprising a VL CDR1, a VL CDR2, and a VL CDR3 having an amino acid sequence of a VL CDR1, a VL CDR2, and a VL CDR3, respectively, of SEQ ID NO:3602. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:3635; and (ii) a VL comprising a VL CDR1, a VL CDR2, and a VL CDR3 having an amino acid sequence of a VL CDR1, a VL CDR2, and a VL CDR3, respectively, of SEQ ID NO:3636. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:3669; and (ii) a VL comprising a VL CDR1, a VL CDR2, and a VL CDR3 having an amino acid sequence of a VL CDR1, a VL CDR2, and a VL CDR3, respectively, of SEQ ID NO:3670. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:3703; and (ii) a VL comprising a VL CDR1, a VL CDR2, and a VL CDR3 having an amino acid sequence of a VL CDR1, a VL CDR2, and a VL CDR3, respectively, of SEQ ID NO:3704. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:3737; and (ii) a VL comprising a VL CDR1, a VL CDR2, and a VL CDR3 having an amino acid sequence of a VL CDR1, a VL CDR2, and a VL CDR3, respectively, of SEQ ID NO:3738. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:3771; and (ii) a VL comprising a VL CDR1, a VL CDR2, and a VL CDR3 having an amino acid sequence of a VL CDR1, a VL CDR2, and a VL CDR3, respectively, of SEQ ID NO:3772. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:3805; and (ii) a VL comprising a VL CDR1, a VL CDR2, and a VL CDR3 having an amino acid sequence of a VL CDR1, a VL CDR2, and a VL CDR3, respectively, of SEQ ID NO:3806. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:3839; and (ii) a VL comprising a VL CDR1, a VL CDR2, and a VL CDR3 having an amino acid sequence of a VL CDR1, a VL CDR2, and a VL CDR3, respectively, of SEQ ID NO:3840. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:3873; and (ii) a VL comprising a VL CDR1, a VL CDR2, and a VL CDR3 having an amino acid sequence of a VL CDR1, a VL CDR2, and a VL CDR3, respectively, of SEQ ID NO:3874. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:3907; and (ii) a VL comprising a VL CDR1, a VL CDR2, and a VL CDR3 having an amino acid sequence of a VL CDR1, a VL CDR2, and a VL CDR3, respectively, of SEQ ID NO:3908. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:3941; and (ii) a VL comprising a VL CDR1, a VL CDR2, and a VL CDR3 having an amino acid sequence of a VL CDR1, a VL CDR2, and a VL CDR3, respectively, of SEQ ID NO:3942. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:3975; and (ii) a VL comprising a VL CDR1, a VL CDR2, and a VL CDR3 having an amino acid sequence of a VL CDR1, a VL CDR2, and a VL CDR3, respectively, of SEQ ID NO:3976. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:4009; and (ii) a VL comprising a VL CDR1, a VL CDR2, and a VL CDR3 having an amino acid sequence of a VL CDR1, a VL CDR2, and a VL CDR3, respectively, of SEQ ID NO:4010. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:4043; and (ii) a VL comprising a VL CDR1, a VL CDR2, and a VL CDR3 having an amino acid sequence of a VL CDR1, a VL CDR2, and a VL CDR3, respectively, of SEQ ID NO:4044. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:4077; and (ii) a VL comprising a VL CDR1, a VL CDR2, and a VL CDR3 having an amino acid sequence of a VL CDR1, a VL CDR2, and a VL CDR3, respectively, of SEQ ID NO:4078. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:4111; and (ii) a VL comprising a VL CDR1, a VL CDR2, and a VL CDR3 having an amino acid sequence of a VL CDR1, a VL CDR2, and a VL CDR3, respectively, of SEQ ID NO:4112. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:4145; and (ii) a VL comprising a VL CDR1, a VL CDR2, and a VL CDR3 having an amino acid sequence of a VL CDR1, a VL CDR2, and a VL CDR3, respectively, of SEQ ID NO:4146. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:4179; and (ii) a VL comprising a VL CDR1, a VL CDR2, and a VL CDR3 having an amino acid sequence of a VL CDR1, a VL CDR2, and a VL CDR3, respectively, of SEQ ID NO:4180. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:4213; and (ii) a VL comprising a VL CDR1, a VL CDR2, and a VL CDR3 having an amino acid sequence of a VL CDR1, a VL CDR2, and a VL CDR3, respectively, of SEQ ID NO:4214. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:4247; and (ii) a VL comprising a VL CDR1, a VL CDR2, and a VL CDR3 having an amino acid sequence of a VL CDR1, a VL CDR2, and a VL CDR3, respectively, of SEQ ID NO:4248. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:4281; and (ii) a VL comprising a VL CDR1, a VL CDR2, and a VL CDR3 having an amino acid sequence of a VL CDR1, a VL CDR2, and a VL CDR3, respectively, of SEQ ID NO:4282. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:4315; and (ii) a VL comprising a VL CDR1, a VL CDR2, and a VL CDR3 having an amino acid sequence of a VL CDR1, a VL CDR2, and a VL CDR3, respectively, of SEQ ID NO:4316. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:4349; and (ii) a VL comprising a VL CDR1, a VL CDR2, and a VL CDR3 having an amino acid sequence of a VL CDR1, a VL CDR2, and a VL CDR3, respectively, of SEQ ID NO:4350. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:4383; and (ii) a VL comprising a VL CDR1, a VL CDR2, and a VL CDR3 having an amino acid sequence of a VL CDR1, a VL CDR2, and a VL CDR3, respectively, of SEQ ID NO:4384. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:4417; and (ii) a VL comprising a VL CDR1, a VL CDR2, and a VL CDR3 having an amino acid sequence of a VL CDR1, a VL CDR2, and a VL CDR3, respectively, of SEQ ID NO:4418. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:4451; and (ii) a VL comprising a VL CDR1, a VL CDR2, and a VL CDR3 having an amino acid sequence of a VL CDR1, a VL CDR2, and a VL CDR3, respectively, of SEQ ID NO:4452. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:4485; and (ii) a VL comprising a VL CDR1, a VL CDR2, and a VL CDR3 having an amino acid sequence of a VL CDR1, a VL CDR2, and a VL CDR3, respectively, of SEQ ID NO:4486. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:4519; and (ii) a VL comprising a VL CDR1, a VL CDR2, and a VL CDR3 having an amino acid sequence of a VL CDR1, a VL CDR2, and a VL CDR3, respectively, of SEQ ID NO:4520. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:4553; and (ii) a VL comprising a VL CDR1, a VL CDR2, and a VL CDR3 having an amino acid sequence of a VL CDR1, a VL CDR2, and a VL CDR3, respectively, of SEQ ID NO:4554. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:4587; and (ii) a VL comprising a VL CDR1, a VL CDR2, and a VL CDR3 having an amino acid sequence of a VL CDR1, a VL CDR2, and a VL CDR3, respectively, of SEQ ID NO:4588. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:4621; and (ii) a VL comprising a VL CDR1, a VL CDR2, and a VL CDR3 having an amino acid sequence of a VL CDR1, a VL CDR2, and a VL CDR3, respectively, of SEQ ID NO:4622. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:4655; and (ii) a VL comprising a VL CDR1, a VL CDR2, and a VL CDR3 having an amino acid sequence of a VL CDR1, a VL CDR2, and a VL CDR3, respectively, of SEQ ID NO:4656. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:4689; and (ii) a VL comprising a VL CDR1, a VL CDR2, and a VL CDR3 having an amino acid sequence of a VL CDR1, a VL CDR2, and a VL CDR3, respectively, of SEQ ID NO:4690. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:4723; and (ii) a VL comprising a VL CDR1, a VL CDR2, and a VL CDR3 having an amino acid sequence of a VL CDR1, a VL CDR2, and a VL CDR3, respectively, of SEQ ID NO:4724. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:4757; and (ii) a VL comprising a VL CDR1, a VL CDR2, and a VL CDR3 having an amino acid sequence of a VL CDR1, a VL CDR2, and a VL CDR3, respectively, of SEQ ID NO:4758. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:4791; and (ii) a VL comprising a VL CDR1, a VL CDR2, and a VL CDR3 having an amino acid sequence of a VL CDR1, a VL CDR2, and a VL CDR3, respectively, of SEQ ID NO:4792. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:4825; and (ii) a VL comprising a VL CDR1, a VL CDR2, and a VL CDR3 having an amino acid sequence of a VL CDR1, a VL CDR2, and a VL CDR3, respectively, of SEQ ID NO:4826. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:4859; and (ii) a VL comprising a VL CDR1, a VL CDR2, and a VL CDR3 having an amino acid sequence of a VL CDR1, a VL CDR2, and a VL CDR3, respectively, of SEQ ID NO:4860. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:4893; and (ii) a VL comprising a VL CDR1, a VL CDR2, and a VL CDR3 having an amino acid sequence of a VL CDR1, a VL CDR2, and a VL CDR3, respectively, of SEQ ID NO:4894. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:4927; and (ii) a VL comprising a VL CDR1, a VL CDR2, and a VL CDR3 having an amino acid sequence of a VL CDR1, a VL CDR2, and a VL CDR3, respectively, of SEQ ID NO:4928. In one embodiment, the CD4 reference antibody comprises: (i) a VH comprising a VH CDR1, a VH CDR2, and a VH CDR3 having an amino acid sequence of a VH CDR1, a VH CDR2, and a VH CDR3, respectively, of SEQ ID NO:4961; and (ii) a VL comprising a VL CDR1, a VL CDR2, and a VL CDR3 having an amino acid sequence of a VL CDR1, a VL CDR2, and a VL CDR3, respectively, of SEQ ID NO:4962.

In another aspect, provided herein is a multispecific antibody that binds CD4. In some embodiments, the multispecific antibody is a bispecific antibody. In some embodiments, the multispecific antibody is a trispecific antibody. In some embodiments, the multispecific antibody is a quadraspecific antibody. In one embodiment, the multispecific CD4 antibody comprises: (a) a first binding domain that binds CD4, and (b) a second binding domain that binds to a second target. In one embodiment, the multispecific CD4 antibody comprises: (a) a first binding domain that binds CD4, and (b) a second binding domain that binds to a second target, and (c) a third binding domain that binds to a third target. In one embodiment, the multispecific CD4 antibody comprises: (a) a first binding domain that binds CD4, and (b) a second binding domain that binds to a second target, (c) a third binding domain that binds to a third target, and (d) a fourth binding domain that binds to a fourth target.

In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:2207; and (ii) a VL comprising a VL CDR1, a VL CDR2, and a VL CDR3 having an amino acid sequence of a VL CDR1, a VL CDR2, and a VL CDR3, respectively, of SEQ ID NO:2208. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:2241; and (ii) a VL comprising a VL CDR1, a VL CDR2, and a VL CDR3 having an amino acid sequence of a VL CDR1, a VL CDR2, and a VL CDR3, respectively, of SEQ ID NO:2242. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:2275; and (ii) a VL comprising a VL CDR1, a VL CDR2, and a VL CDR3 having an amino acid sequence of a VL CDR1, a VL CDR2, and a VL CDR3, respectively, of SEQ ID NO:2276. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:2309; and (ii) a VL comprising a VL CDR1, a VL CDR2, and a VL CDR3 having an amino acid sequence of a VL CDR1, a VL CDR2, and a VL CDR3, respectively, of SEQ ID NO:2310. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:2343; and (ii) a VL comprising a VL CDR1, a VL CDR2, and a VL CDR3 having an amino acid sequence of a VL CDR1, a VL CDR2, and a VL CDR3, respectively, of SEQ ID NO:2344. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:2377; and (ii) a VL comprising a VL CDR1, a VL CDR2, and a VL CDR3 having an amino acid sequence of a VL CDR1, a VL CDR2, and a VL CDR3, respectively, of SEQ ID NO:2378. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:2411; and (ii) a VL comprising a VL CDR1, a VL CDR2, and a VL CDR3 having an amino acid sequence of a VL CDR1, a VL CDR2, and a VL CDR3, respectively, of SEQ ID NO:2412. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:2445; and (ii) a VL comprising a VL CDR1, a VL CDR2, and a VL CDR3 having an amino acid sequence of a VL CDR1, a VL CDR2, and a VL CDR3, respectively, of SEQ ID NO:2446. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:2479; and (ii) a VL comprising a VL CDR1, a VL CDR2, and a VL CDR3 having an amino acid sequence of a VL CDR1, a VL CDR2, and a VL CDR3, respectively, of SEQ ID NO:2480. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:2513; and (ii) a VL comprising a VL CDR1, a VL CDR2, and a VL CDR3 having an amino acid sequence of a VL CDR1, a VL CDR2, and a VL CDR3, respectively, of SEQ ID NO:2514. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:2547; and (ii) a VL comprising a VL CDR1, a VL CDR2, and a VL CDR3 having an amino acid sequence of a VL CDR1, a VL CDR2, and a VL CDR3, respectively, of SEQ ID NO:2548. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:2581; and (ii) a VL comprising a VL CDR1, a VL CDR2, and a VL CDR3 having an amino acid sequence of a VL CDR1, a VL CDR2, and a VL CDR3, respectively, of SEQ ID NO:2582. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:2615; and (ii) a VL comprising a VL CDR1, a VL CDR2, and a VL CDR3 having an amino acid sequence of a VL CDR1, a VL CDR2, and a VL CDR3, respectively, of SEQ ID NO:2616. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:2649; and (ii) a VL comprising a VL CDR1, a VL CDR2, and a VL CDR3 having an amino acid sequence of a VL CDR1, a VL CDR2, and a VL CDR3, respectively, of SEQ ID NO:2650. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:2683; and (ii) a VL comprising a VL CDR1, a VL CDR2, and a VL CDR3 having an amino acid sequence of a VL CDR1, a VL CDR2, and a VL CDR3, respectively, of SEQ ID NO:2684. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:2717; and (ii) a VL comprising a VL CDR1, a VL CDR2, and a VL CDR3 having an amino acid sequence of a VL CDR1, a VL CDR2, and a VL CDR3, respectively, of SEQ ID NO:2718. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:2751; and (ii) a VL comprising a VL CDR1, a VL CDR2, and a VL CDR3 having an amino acid sequence of a VL CDR1, a VL CDR2, and a VL CDR3, respectively, of SEQ ID NO:2752. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:2785; and (ii) a VL comprising a VL CDR1, a VL CDR2, and a VL CDR3 having an amino acid sequence of a VL CDR1, a VL CDR2, and a VL CDR3, respectively, of SEQ ID NO:2786. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:2819; and (ii) a VL comprising a VL CDR1, a VL CDR2, and a VL CDR3 having an amino acid sequence of a VL CDR1, a VL CDR2, and a VL CDR3, respectively, of SEQ ID NO:2820. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:2853; and (ii) a VL comprising a VL CDR1, a VL CDR2, and a VL CDR3 having an amino acid sequence of a VL CDR1, a VL CDR2, and a VL CDR3, respectively, of SEQ ID NO:2854. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:2887; and (ii) a VL comprising a VL CDR1, a VL CDR2, and a VL CDR3 having an amino acid sequence of a VL CDR1, a VL CDR2, and a VL CDR3, respectively, of SEQ ID NO:2888. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:2921; and (ii) a VL comprising a VL CDR1, a VL CDR2, and a VL CDR3 having an amino acid sequence of a VL CDR1, a VL CDR2, and a VL CDR3, respectively, of SEQ ID NO:2922. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:2955; and (ii) a VL comprising a VL CDR1, a VL CDR2, and a VL CDR3 having an amino acid sequence of a VL CDR1, a VL CDR2, and a VL CDR3, respectively, of SEQ ID NO:2956. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:2989; and (ii) a VL comprising a VL CDR1, a VL CDR2, and a VL CDR3 having an amino acid sequence of a VL CDR1, a VL CDR2, and a VL CDR3, respectively, of SEQ ID NO:2990. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:3023; and (ii) a VL comprising a VL CDR1, a VL CDR2, and a VL CDR3 having an amino acid sequence of a VL CDR1, a VL CDR2, and a VL CDR3, respectively, of SEQ ID NO:3024. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:3057; and (ii) a VL comprising a VL CDR1, a VL CDR2, and a VL CDR3 having an amino acid sequence of a VL CDR1, a VL CDR2, and a VL CDR3, respectively, of SEQ ID NO:3058. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:3091; and (ii) a VL comprising a VL CDR1, a VL CDR2, and a VL CDR3 having an amino acid sequence of a VL CDR1, a VL CDR2, and a VL CDR3, respectively, of SEQ ID NO:3092. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:3125; and (ii) a VL comprising a VL CDR1, a VL CDR2, and a VL CDR3 having an amino acid sequence of a VL CDR1, a VL CDR2, and a VL CDR3, respectively, of SEQ ID NO:3126. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:3159; and (ii) a VL comprising a VL CDR1, a VL CDR2, and a VL CDR3 having an amino acid sequence of a VL CDR1, a VL CDR2, and a VL CDR3, respectively, of SEQ ID NO:3160. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:3193; and (ii) a VL comprising a VL CDR1, a VL CDR2, and a VL CDR3 having an amino acid sequence of a VL CDR1, a VL CDR2, and a VL CDR3, respectively, of SEQ ID NO:3194. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:3227; and (ii) a VL comprising a VL CDR1, a VL CDR2, and a VL CDR3 having an amino acid sequence of a VL CDR1, a VL CDR2, and a VL CDR3, respectively, of SEQ ID NO:3228. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:3261; and (ii) a VL comprising a VL CDR1, a VL CDR2, and a VL CDR3 having an amino acid sequence of a VL CDR1, a VL CDR2, and a VL CDR3, respectively, of SEQ ID NO:3262. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:3295; and (ii) a VL comprising a VL CDR1, a VL CDR2, and a VL CDR3 having an amino acid sequence of a VL CDR1, a VL CDR2, and a VL CDR3, respectively, of SEQ ID NO:3296. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:3329; and (ii) a VL comprising a VL CDR1, a VL CDR2, and a VL CDR3 having an amino acid sequence of a VL CDR1, a VL CDR2, and a VL CDR3, respectively, of SEQ ID NO:3330. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:3363; and (ii) a VL comprising a VL CDR1, a VL CDR2, and a VL CDR3 having an amino acid sequence of a VL CDR1, a VL CDR2, and a VL CDR3, respectively, of SEQ ID NO:3364. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:3397; and (ii) a VL comprising a VL CDR1, a VL CDR2, and a VL CDR3 having an amino acid sequence of a VL CDR1, a VL CDR2, and a VL CDR3, respectively, of SEQ ID NO:3398. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:3431; and (ii) a VL comprising a VL CDR1, a VL CDR2, and a VL CDR3 having an amino acid sequence of a VL CDR1, a VL CDR2, and a VL CDR3, respectively, of SEQ ID NO:3432. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:3465; and (ii) a VL comprising a VL CDR1, a VL CDR2, and a VL CDR3 having an amino acid sequence of a VL CDR1, a VL CDR2, and a VL CDR3, respectively, of SEQ ID NO:3466. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:3499; and (ii) a VL comprising a VL CDR1, a VL CDR2, and a VL CDR3 having an amino acid sequence of a VL CDR1, a VL CDR2, and a VL CDR3, respectively, of SEQ ID NO:3500. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:3533; and (ii) a VL comprising a VL CDR1, a VL CDR2, and a VL CDR3 having an amino acid sequence of a VL CDR1, a VL CDR2, and a VL CDR3, respectively, of SEQ ID NO:3534. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:3567; and (ii) a VL comprising a VL CDR1, a VL CDR2, and a VL CDR3 having an amino acid sequence of a VL CDR1, a VL CDR2, and a VL CDR3, respectively, of SEQ ID NO:3568. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:3601; and (ii) a VL comprising a VL CDR1, a VL CDR2, and a VL CDR3 having an amino acid sequence of a VL CDR1, a VL CDR2, and a VL CDR3, respectively, of SEQ ID NO:3602. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:3635; and (ii) a VL comprising a VL CDR1, a VL CDR2, and a VL CDR3 having an amino acid sequence of a VL CDR1, a VL CDR2, and a VL CDR3, respectively, of SEQ ID NO:3636. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:3669; and (ii) a VL comprising a VL CDR1, a VL CDR2, and a VL CDR3 having an amino acid sequence of a VL CDR1, a VL CDR2, and a VL CDR3, respectively, of SEQ ID NO:3670. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:3703; and (ii) a VL comprising a VL CDR1, a VL CDR2, and a VL CDR3 having an amino acid sequence of a VL CDR1, a VL CDR2, and a VL CDR3, respectively, of SEQ ID NO:3704. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:3737; and (ii) a VL comprising a VL CDR1, a VL CDR2, and a VL CDR3 having an amino acid sequence of a VL CDR1, a VL CDR2, and a VL CDR3, respectively, of SEQ ID NO:3738. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:3771; and (ii) a VL comprising a VL CDR1, a VL CDR2, and a VL CDR3 having an amino acid sequence of a VL CDR1, a VL CDR2, and a VL CDR3, respectively, of SEQ ID NO:3772. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:3805; and (ii) a VL comprising a VL CDR1, a VL CDR2, and a VL CDR3 having an amino acid sequence of a VL CDR1, a VL CDR2, and a VL CDR3, respectively, of SEQ ID NO:3806. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:3839; and (ii) a VL comprising a VL CDR1, a VL CDR2, and a VL CDR3 having an amino acid sequence of a VL CDR1, a VL CDR2, and a VL CDR3, respectively, of SEQ ID NO:3840. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:3873; and (ii) a VL comprising a VL CDR1, a VL CDR2, and a VL CDR3 having an amino acid sequence of a VL CDR1, a VL CDR2, and a VL CDR3, respectively, of SEQ ID NO:3874. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:3907; and (ii) a VL comprising a VL CDR1, a VL CDR2, and a VL CDR3 having an amino acid sequence of a VL CDR1, a VL CDR2, and a VL CDR3, respectively, of SEQ ID NO:3908. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:3941; and (ii) a VL comprising a VL CDR1, a VL CDR2, and a VL CDR3 having an amino acid sequence of a VL CDR1, a VL CDR2, and a VL CDR3, respectively, of SEQ ID NO:3942. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:3975; and (ii) a VL comprising a VL CDR1, a VL CDR2, and a VL CDR3 having an amino acid sequence of a VL CDR1, a VL CDR2, and a VL CDR3, respectively, of SEQ ID NO:3976. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:4009; and (ii) a VL comprising a VL CDR1, a VL CDR2, and a VL CDR3 having an amino acid sequence of a VL CDR1, a VL CDR2, and a VL CDR3, respectively, of SEQ ID NO:4010. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:4043; and (ii) a VL comprising a VL CDR1, a VL CDR2, and a VL CDR3 having an amino acid sequence of a VL CDR1, a VL CDR2, and a VL CDR3, respectively, of SEQ ID NO:4044. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:4077; and (ii) a VL comprising a VL CDR1, a VL CDR2, and a VL CDR3 having an amino acid sequence of a VL CDR1, a VL CDR2, and a VL CDR3, respectively, of SEQ ID NO:4078. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:4111; and (ii) a VL comprising a VL CDR1, a VL CDR2, and a VL CDR3 having an amino acid sequence of a VL CDR1, a VL CDR2, and a VL CDR3, respectively, of SEQ ID NO:4112. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:4145; and (ii) a VL comprising a VL CDR1, a VL CDR2, and a VL CDR3 having an amino acid sequence of a VL CDR1, a VL CDR2, and a VL CDR3, respectively, of SEQ ID NO:4146. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:4179; and (ii) a VL comprising a VL CDR1, a VL CDR2, and a VL CDR3 having an amino acid sequence of a VL CDR1, a VL CDR2, and a VL CDR3, respectively, of SEQ ID NO:4180. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:4213; and (ii) a VL comprising a VL CDR1, a VL CDR2, and a VL CDR3 having an amino acid sequence of a VL CDR1, a VL CDR2, and a VL CDR3, respectively, of SEQ ID NO:4214. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:4247; and (ii) a VL comprising a VL CDR1, a VL CDR2, and a VL CDR3 having an amino acid sequence of a VL CDR1, a VL CDR2, and a VL CDR3, respectively, of SEQ ID NO:4248. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:4281; and (ii) a VL comprising a VL CDR1, a VL CDR2, and a VL CDR3 having an amino acid sequence of a VL CDR1, a VL CDR2, and a VL CDR3, respectively, of SEQ ID NO:4282. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:4315; and (ii) a VL comprising a VL CDR1, a VL CDR2, and a VL CDR3 having an amino acid sequence of a VL CDR1, a VL CDR2, and a VL CDR3, respectively, of SEQ ID NO:4316. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:4349; and (ii) a VL comprising a VL CDR1, a VL CDR2, and a VL CDR3 having an amino acid sequence of a VL CDR1, a VL CDR2, and a VL CDR3, respectively, of SEQ ID NO:4350. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:4383; and (ii) a VL comprising a VL CDR1, a VL CDR2, and a VL CDR3 having an amino acid sequence of a VL CDR1, a VL CDR2, and a VL CDR3, respectively, of SEQ ID NO:4384. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:4417; and (ii) a VL comprising a VL CDR1, a VL CDR2, and a VL CDR3 having an amino acid sequence of a VL CDR1, a VL CDR2, and a VL CDR3, respectively, of SEQ ID NO:4418. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:4451; and (ii) a VL comprising a VL CDR1, a VL CDR2, and a VL CDR3 having an amino acid sequence of a VL CDR1, a VL CDR2, and a VL CDR3, respectively, of SEQ ID NO:4452. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:4485; and (ii) a VL comprising a VL CDR1, a VL CDR2, and a VL CDR3 having an amino acid sequence of a VL CDR1, a VL CDR2, and a VL CDR3, respectively, of SEQ ID NO:4486. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:4519; and (ii) a VL comprising a VL CDR1, a VL CDR2, and a VL CDR3 having an amino acid sequence of a VL CDR1, a VL CDR2, and a VL CDR3, respectively, of SEQ ID NO:4520. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:4553; and (ii) a VL comprising a VL CDR1, a VL CDR2, and a VL CDR3 having an amino acid sequence of a VL CDR1, a VL CDR2, and a VL CDR3, respectively, of SEQ ID NO:4554. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:4587; and (ii) a VL comprising a VL CDR1, a VL CDR2, and a VL CDR3 having an amino acid sequence of a VL CDR1, a VL CDR2, and a VL CDR3, respectively, of SEQ ID NO:4588. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:4621; and (ii) a VL comprising a VL CDR1, a VL CDR2, and a VL CDR3 having an amino acid sequence of a VL CDR1, a VL CDR2, and a VL CDR3, respectively, of SEQ ID NO:4622. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:4655; and (ii) a VL comprising a VL CDR1, a VL CDR2, and a VL CDR3 having an amino acid sequence of a VL CDR1, a VL CDR2, and a VL CDR3, respectively, of SEQ ID NO:4656. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:4689; and (ii) a VL comprising a VL CDR1, a VL CDR2, and a VL CDR3 having an amino acid sequence of a VL CDR1, a VL CDR2, and a VL CDR3, respectively, of SEQ ID NO:4690. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:4723; and (ii) a VL comprising a VL CDR1, a VL CDR2, and a VL CDR3 having an amino acid sequence of a VL CDR1, a VL CDR2, and a VL CDR3, respectively, of SEQ ID NO:4724. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:4757; and (ii) a VL comprising a VL CDR1, a VL CDR2, and a VL CDR3 having an amino acid sequence of a VL CDR1, a VL CDR2, and a VL CDR3, respectively, of SEQ ID NO:4758. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:4791; and (ii) a VL comprising a VL CDR1, a VL CDR2, and a VL CDR3 having an amino acid sequence of a VL CDR1, a VL CDR2, and a VL CDR3, respectively, of SEQ ID NO:4792. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:4825; and (ii) a VL comprising a VL CDR1, a VL CDR2, and a VL CDR3 having an amino acid sequence of a VL CDR1, a VL CDR2, and a VL CDR3, respectively, of SEQ ID NO:4826. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:4859; and (ii) a VL comprising a VL CDR1, a VL CDR2, and a VL CDR3 having an amino acid sequence of a VL CDR1, a VL CDR2, and a VL CDR3, respectively, of SEQ ID NO:4860. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:4893; and (ii) a VL comprising a VL CDR1, a VL CDR2, and a VL CDR3 having an amino acid sequence of a VL CDR1, a VL CDR2, and a VL CDR3, respectively, of SEQ ID NO:4894. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:4927; and (ii) a VL comprising a VL CDR1, a VL CDR2, and a VL CDR3 having an amino acid sequence of a VL CDR1, a VL CDR2, and a VL CDR3, respectively, of SEQ ID NO:4928. In one embodiment, the first binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:4961; and (ii) a VL comprising a VL CDR1, a VL CDR2, and a VL CDR3 having an amino acid sequence of a VL CDR1, a VL CDR2, and a VL CDR3, respectively, of SEQ ID NO:4962.

In some embodiments, the VH CDR1, VH CDR2, VH CDR3, VL CDR1, VL CDR2, and VL CDR3 amino acid sequences of the first binding domain that binds CD4 are according to the Kabat numbering system. In some embodiments, the VH CDR1, VH CDR2, VH CDR3, VL CDR1, VL CDR2, and VL CDR3 amino acid sequences of the first binding domain that binds CD4 are according to the Chothia numbering system. In some embodiments, the VH CDR1, VH CDR2, VH CDR3, VL CDR1, VL CDR2, and VL CDR3 amino acid sequences of the first binding domain that binds CD4 are according to the AbM numbering system. In some embodiments, the VH CDR1, VH CDR2, VH CDR3, VL CDR1, VL CDR2, and VL CDR3 amino acid sequences of the first binding domain that binds CD4 are according to the Contact numbering system. In some embodiments, the VH CDR1, VH CDR2, VH CDR3, VL CDR1, VL CDR2, and VL CDR3 amino acid sequences of the first binding domain that binds CD4 are according to the IMGT numbering system.

In some embodiments, the first binding domain binds a CD4 antigen. In some embodiments, the first binding domain binds a CD4 epitope. In some embodiments, the first binding domain specifically binds to CD4. In some embodiments, the VH CDR1, VH CDR2, VH CDR3, VL CDR1, VL CDR2 and VL CDR3 of the first binding domain form a binding site for an antigen of the CD4. In some embodiments, the VH CDR1, VH CDR2, VH CDR3, VL CDR1, VL CDR2 and VL CDR3 of the first binding domain form a binding site for an epitope of the CD4. In some embodiments, the CD4 is present on the surface of a T cell.

In some embodiments of the multispecific CD4 antibodies provided herein, the second target is not a CD4 antigen. In some embodiments of the multispecific CD4 antibodies provided herein, the third target is not a CD4 antigen. In some embodiments of the multispecific CD4 antibodies provided herein, the fourth target is not a CD4 antigen. In some embodiments of the multispecific CD4 antibodies provided herein, the second target is not a CD4 antigen, and the third target is not a CD4 antigen. In some embodiments of the multispecific CD4 antibodies provided herein, the second target is not a CD4 antigen, and the fourth target is not a CD4 antigen. In some embodiments of the multispecific CD4 antibodies provided herein, the third target is not a CD4 antigen, and the fourth target is not a CD4 antigen. In some embodiments of the multispecific CD4 antibodies provided herein, the second target is not a CD4 antigen, the third target is not a CD4 antigen, and the fourth target is not a CD4 antigen. In some embodiments of the multispecific CD4 antibodies provided herein, the second target is not a CD4 epitope. In some embodiments of the multispecific CD4 antibodies provided herein, the third target is not a CD4 epitope. In some embodiments of the multispecific CD4 antibodies provided herein, the fourth target is not a CD4 epitope. In some embodiments of the multispecific CD4 antibodies provided herein, the second target is not a CD4 epitope, and the third target is not a CD4 epitope. In some embodiments of the multispecific CD4 antibodies provided herein, the second target is not a CD4 epitope, and the fourth target is not a CD4 epitope. In some embodiments of the multispecific CD4 antibodies provided herein, the third target is not a CD4 epitope, and the fourth target is not a CD4 epitope. In some embodiments of the multispecific CD4 antibodies provided herein, the second target is not a CD4 epitope, the third target is not a CD4 epitope, and the fourth target is not a CD4 epitope.

In some embodiments of the multispecific CD4 antibodies provided herein, the second target is CD8. In some embodiments of the multispecific CD4 antibodies provided herein, the second target is a T cell receptor (TCR) complex. As used herein, "TCR complex" refers to a known TCR complex comprising TCRα and TCRβ chains, CD3ε, CD3γ, CD3δ, and CD3ζ molecules. In certain embodiments, TCRα and TCRβ chains are replaced by TCRγ and TCRδ chains. The amino acid sequences of the various proteins forming the TCR complex are known. In some embodiments of the multispecific CD4 antibodies provided herein, the second target is CD3. In some embodiments, CD3 comprises CD3ε. In some embodiments, CD3 comprises CD3γ. In some embodiments, CD3 comprises CD3δ. In some embodiments, CD3 comprises CD3ζ. In some embodiments of the multispecific CD4 antibodies provided herein, the second target is CD3ε. In some embodiments of the multispecific CD4 antibodies provided herein, the second target is CD3γ. In some embodiments of the multispecific CD4 antibodies provided herein, the second target is CD3δ. In some embodiments of the multispecific CD4 antibodies provided herein, the second target is CD3ζ. In some embodiments of the multispecific CD4 antibodies provided herein, the second target is a TCRα chain. In some embodiments of the multispecific CD4 antibodies provided herein, the second target is a TCRβ chain. In some embodiments of the multispecific CD4 antibodies provided herein, the second target is a TCRγ chain. In some embodiments of the multispecific CD4 antibodies provided herein, the second target is a TCRδ chain. In some embodiments of the multispecific CD4 antibodies provided herein, the second target is a T cell costimulatory molecule. In some embodiments of the multispecific CD4 antibodies provided herein, the second target is CD28. In some embodiments of the multispecific CD4 antibodies provided herein, the second target is CTLA4. In some embodiments of the multispecific CD4 antibodies provided herein, the second target is ICOS. In some embodiments of the multispecific CD4 antibodies provided herein, the second target is 4-1BB. In some embodiments of the multispecific CD4 antibodies provided herein, the second target is GITR. In some embodiments of the multispecific CD4 antibodies provided herein, the second target is CD27. In some embodiments of the multispecific CD4 antibodies provided herein, the second target is OX40. In some embodiments of the multispecific CD4 antibodies provided herein, the second target is CD40L. In some embodiments of the multispecific CD4 antibodies provided herein, the second target is HVEM. In some embodiments of the multispecific CD4 antibodies provided herein, the second target is Galectin-9. In some embodiments of the multispecific CD4 antibodies provided herein, the second target is TIM-1. In some embodiments of the multispecific CD4 antibodies provided herein, the second target is LFA1. In some embodiments of the multispecific CD4 antibodies provided herein, the second target is CD2. In some embodiments of the multispecific CD4 antibodies provided herein, the second target is PD1. In some embodiments of the multispecific CD4 antibodies provided herein, the third target is a TCR complex. In some embodiments of the multispecific CD4 antibodies provided herein, the third target is CD3. In some embodiments of the multispecific CD4 antibodies provided herein, the third target is CD3ε. In some embodiments of the multispecific CD4 antibodies provided herein, the third target is CD3γ. In some embodiments of the multispecific CD4 antibodies provided herein, the third target is CD3δ. In some embodiments of the multispecific CD4 antibodies provided herein, the third target is CD3ζ. In some embodiments of the multispecific CD4 antibodies provided herein, the third target is a TCRα chain. In some embodiments of the multispecific CD4 antibodies provided herein, the third target is a TCRβ chain. In some embodiments of the multispecific CD4 antibodies provided herein, the third target is a TCRγ chain. In some embodiments of the multispecific CD4 antibodies provided herein, the third target is a TCRδ chain. In some embodiments of the multispecific CD4 antibodies provided herein, the third target is a T cell costimulatory molecule. In some embodiments of the multispecific CD4 antibodies provided herein, the third target is CD28. In some embodiments of the multispecific CD4 antibodies provided herein, the third target is CTLA4. In some embodiments of the multispecific CD4 antibodies provided herein, the third target is ICOS. In some embodiments of the multispecific CD4 antibodies provided herein, the third target is 4-1BB. In some embodiments of the multispecific CD4 antibodies provided herein, the third target is GITR. In some embodiments of the multispecific CD4 antibodies provided herein, the third target is CD27. In some embodiments of the multispecific CD4 antibodies provided herein, the third target is OX40. In some embodiments of the multispecific CD4 antibodies provided herein, the third target is CD40L. In some embodiments of the multispecific CD4 antibodies provided herein, the third target is HVEM. In some embodiments of the multispecific CD4 antibodies provided herein, the third target is Galectin-9. In some embodiments of the multispecific CD4 antibodies provided herein, the third target is TIM-1. In some embodiments of the multispecific CD4 antibodies provided herein, the third target is LFA1. In some embodiments of the multispecific CD4 antibodies provided herein, the third target is CD2. In some embodiments of the multispecific CD4 antibodies provided herein, the third target is PD1. In some embodiments of the multispecific CD4 antibodies provided herein, the fourth target is a TCR complex. In some embodiments of the multispecific CD4 antibodies provided herein, the fourth target is CD3. In some embodiments of the multispecific CD4 antibodies provided herein, the fourth target is CD3ε. In some embodiments of the multispecific CD4 antibodies provided herein, the fourth target is CD3γ. In some embodiments of the multispecific CD4 antibodies provided herein, the fourth target is CD3δ. In some embodiments of the multispecific CD4 antibodies provided herein, the fourth target is CD3ζ. In some embodiments of the multispecific CD4 antibodies provided herein, the fourth target is a TCRα chain. In some embodiments of the multispecific CD4 antibodies provided herein, the fourth target is a TCRβ chain. In some embodiments of the multispecific CD4 antibodies provided herein, the fourth target is a TCRγ chain. In some embodiments of the multispecific CD4 antibodies provided herein, the fourth target is a TCRδ chain. In some embodiments of the multispecific CD4 antibodies provided herein, the fourth target is a T cell costimulatory molecule. In some embodiments of the multispecific CD4 antibodies provided herein, the fourth target is CD28. In some embodiments of the multispecific CD4 antibodies provided herein, the fourth target is CTLA4. In some embodiments of the multispecific CD4 antibodies provided herein, the fourth target is ICOS. In some embodiments of the multispecific CD4 antibodies provided herein, the fourth target is 4-1BB. In some embodiments of the multispecific CD4 antibodies provided herein, the fourth target is GITR. In some embodiments of the multispecific CD4 antibodies provided herein, the fourth target is CD27. In some embodiments of the multispecific CD4 antibodies provided herein, the fourth target is OX40. In some embodiments of the multispecific CD4 antibodies provided herein, the fourth target is CD40L. In some embodiments of the multispecific CD4 antibodies provided herein, the fourth target is HVEM. In some embodiments of the multispecific CD4 antibodies provided herein, the fourth target is Galectin-9. In some embodiments of the multispecific CD4 antibodies provided herein, the fourth target is TIM-1. In some embodiments of the multispecific CD4 antibodies provided herein, the four target is LFA1. In some embodiments of the multispecific CD4 antibodies provided herein, the fourth target is CD2. In some embodiments of the multispecific CD4 antibodies provided herein, the fourth target is PD1. In some embodiments, the second target is CD8. In some embodiments of the multispecific CD4 antibodies provided herein, the third target is CD3. In some embodiments of the multispecific CD4 antibodies provided herein, the third target is TCRα chain. In some embodiments of the multispecific CD4 antibodies provided herein, the third target is a TCRβ chain. In some embodiments of the multispecific CD4 antibodies provided herein, the third target is a TCRγ chain. In some embodiments of the multispecific CD4 antibodies provided herein, the third target is a TCRδ chain. In some embodiments of the multispecific CD4 antibodies provided herein, the third target is CD28. In some embodiments of the multispecific CD4 antibodies provided herein, the fourth target is CD28.

In some embodiments of the multispecific CD4 antibodies provided herein, the second target is CD8, and the third target is a TCR complex. In some embodiments of the multispecific CD4 antibodies provided herein, the second target is CD8, and the third target is CD3. In some embodiments of the multispecific CD4 antibodies provided herein, the second target is CD8, and the third target is CD3ε. In some embodiments of the multispecific CD4 antibodies provided herein, the second target is CD8, and the third target is CD3γ. In some embodiments of the multispecific CD4 antibodies provided herein, the second target is CD8, and the third target is CD3δ. In some embodiments of the multispecific CD4 antibodies provided herein, the second target is CD8, and the third target is CD3ζ. In some embodiments of the multispecific CD4 antibodies provided herein, the second target is CD8, and the third target is a TCRα chain. In some embodiments of the multispecific CD4 antibodies provided herein, the second target is CD8, and the third target is a TCRβ chain. In some embodiments of the multispecific CD4 antibodies provided herein, the second target is CD8, and the third target is a TCRγ chain.

In some embodiments of the multispecific CD4 antibodies provided herein, the second target is CD8, and the third target is a T cell costimulatory molecule. In some embodiments of the multispecific CD4 antibodies provided herein, the second target is CD8, and the third target is CD28. In some embodiments of the multispecific CD4 antibodies provided herein, the second target is CD8, and the third target is CTLA4. In some embodiments of the multispecific CD4 antibodies provided herein, the second target is CD8, and the third target is ICOS. In some embodiments of the multispecific CD4 antibodies provided herein, the second target is CD8, and the third target is 4-1BB. In some embodiments of the multispecific CD4 antibodies provided herein, the second target is CD8, and the third target is GITR. In some embodiments of the multispecific CD4 antibodies provided herein, the second target is CD8, and the third target is CD27. In some embodiments of the multispecific CD4 antibodies provided herein, the second target is CD8, and the third target is OX40. In some embodiments of the multispecific CD4 antibodies provided herein, the second target is CD8, and the third target is CD40L. In some embodiments of the multispecific CD4 antibodies provided herein, the second target is CD8, and the third target is HVEM. In some embodiments of the multispecific CD4 antibodies provided herein, the second target is CD8, and the third target is Galectin-9. In some embodiments of the multispecific CD4 antibodies provided herein, the second target is CD8, and the third target is TIM-1. In some embodiments of the multispecific CD4 antibodies provided herein, the second target is CD8, and the third target is LFA1. In some embodiments of the multispecific CD4 antibodies provided herein, the second target is CD8, and the third target is CD2. In some embodiments of the multispecific CD4 antibodies provided herein, the second target is CD8, and the third target is PD1.

In some embodiments of the multispecific CD4 antibodies provided herein, the second target is CD8, the third target is a TCR complex, and the fourth target is a T cell costimulatory molecule. In some embodiments of the multispecific CD4 antibodies provided herein, the second target is CD8, the third target is CD3, and the fourth target is a T cell costimulatory molecule. In some embodiments of the multispecific CD4 antibodies provided herein, the second target is CD8, the third target is CD3ε, and the fourth target is a T cell costimulatory molecule. In some embodiments of the multispecific CD4 antibodies provided herein, the second target is CD8, the third target is CD3γ, and the fourth target is a T cell costimulatory molecule. In some embodiments of the multispecific CD4 antibodies provided herein, the second target is CD8, the third target is CD3δ, and the fourth target is a T cell costimulatory molecule. In some embodiments of the multispecific CD4 antibodies provided herein, the second target is CD8, the third target is CD3ζ, and the fourth target is a T cell costimulatory molecule. In some embodiments of the multispecific CD4 antibodies provided herein, the second target is CD8, the third target is a TCRα chain, and the fourth target is a T cell costimulatory molecule. In some embodiments of the multispecific CD4 antibodies provided herein, the second target is CD8, the third target is a TCRβ chain, and the fourth target is a T cell costimulatory molecule. In some embodiments of the multispecific CD4 antibodies provided herein, the second target is CD8, the third target is a TCRγ chain, and the fourth target is a T cell costimulatory molecule. In certain embodiments, the T cell costimulatory molecule is CD28. In certain embodiments, the T cell costimulatory molecule is CTLA4. In certain embodiments, the T cell costimulatory molecule is ICOS. In certain embodiments, the T cell costimulatory molecule is 4-1BB. In certain embodiments, the T cell costimulatory molecule is GITR. In certain embodiments, the T cell costimulatory molecule is CD27. In certain embodiments, the T cell costimulatory molecule is OX40. In certain embodiments, the T cell costimulatory molecule is CD40L. In certain embodiments, the T cell costimulatory molecule is HVEM. In certain embodiments, the T cell costimulatory molecule is Galectin-9. In certain embodiments, the T cell costimulatory molecule is TIM-1. In certain embodiments, the T cell costimulatory molecule is LFA1. In certain embodiments, the T cell costimulatory molecule is CD2. In certain embodiments, the T cell costimulatory molecule is PD1.

In some embodiments of the multispecific CD4 antibodies provided herein, the second target is a TCR complex, and the third target is a T cell costimulatory molecule. In some embodiments of the multispecific CD4 antibodies provided herein, the second target is CD3, and the third target is a T cell costimulatory molecule. In some embodiments of the multispecific CD4 antibodies provided herein, the second target is CD3ε, and the third target is a T cell costimulatory molecule. In some embodiments of the multispecific CD4 antibodies provided herein, the second target is CD3γ, and the third target is a T cell costimulatory molecule. In some embodiments of the multispecific CD4 antibodies provided herein, the second target is CD3δ, and the third target is a T cell costimulatory molecule. In some embodiments of the multispecific CD4 antibodies provided herein, the second target is CD3ζ, and the third target is a T cell costimulatory molecule. In some embodiments of the multispecific CD4 antibodies provided herein, the second target is a TCRα chain, and the third target is a T cell costimulatory molecule. In some embodiments of the multispecific CD4 antibodies provided herein, the second target is a TCRβ chain, and the third target is a T cell costimulatory molecule. In some embodiments of the multispecific CD4 antibodies provided herein, the second target is a TCRγ chain, and the third target is a T cell costimulatory molecule. In certain embodiments, the T cell costimulatory molecule is CD28. In certain embodiments, the T cell costimulatory molecule is CTLA4. In certain embodiments, the T cell costimulatory molecule is ICOS. In certain embodiments, the T cell costimulatory molecule is 4-1BB. In certain embodiments, the T cell costimulatory molecule is GITR. In certain embodiments, the T cell costimulatory molecule is CD27. In certain embodiments, the T cell costimulatory molecule is OX40. In certain embodiments, the T cell costimulatory molecule is CD40L. In certain embodiments, the T cell costimulatory molecule is HVEM. In certain embodiments, the T cell costimulatory molecule is Galectin-9. In certain embodiments, the T cell costimulatory molecule is TIM-1. In certain embodiments, the T cell costimulatory molecule is LFA1. In certain embodiments, the T cell costimulatory molecule is CD2. In certain embodiments, the T cell costimulatory molecule is PD1.

In a specific embodiment, the target is from a mammal. In a specific embodiment, the target is from a rat. In a specific embodiment, the target is from a mouse. In a specific embodiment, the target is from a primate. In a specific embodiment, the target is from a human.

In specific embodiments, provided is a multispecific antibody comprising a CD4 antibody provided herein in a knob-in-hole format. In specific embodiments, provided is a bispecific antibody comprising a CD4 antibody provided herein in a knob-in-hole format. In specific embodiments, provided is a trispecific antibody comprising a CD4 antibody provided herein in a knob-in-hole format. In specific embodiments, provided is a quadraspecific antibody comprising a CD4 antibody provided herein in a knob-in-hole format. Other specificities can be added to an antibody in knob-in-hole format using methods well known in the art (e.g., adding an scFv to the N-terminus or C-terminus). In addition, other formats and methods of making multispecific antibodies are also known in the art and contemplated. In some embodiments, a CD4 antibody provided herein is comprised in a bispecific antibody. In some embodiments, a CD4 antibody provided herein is comprised in a trispecific antibody. In some embodiments, a CD4 antibody provided herein is comprised in a quadraspecific antibody. In some embodiments, a CD4 bispecific antibody provided herein is comprised in a multispecific antibody.

In certain embodiments, a multispecific antibody provided herein comprises a first binding domain comprising a CD4 antibody provided herein that binds to a first CD4 epitope, and a second binding domain that binds to a second epitope, wherein the first CD4 epitope and the second epitope are not the same. In certain embodiments, a bispecific antibody provided herein comprises a first binding domain comprising a CD4 antibody provided herein that binds to a first CD4 epitope, and a second binding domain that binds to a second epitope, wherein the first CD4 epitope and the second epitope are not the same. In certain embodiments, a trispecific antibody provided herein comprises a first binding domain comprising a CD4 antibody provided herein that binds to a first CD4 epitope, a second binding domain that binds to a second epitope, and a third binding domain that binds to a third epitope, wherein the first CD4 epitope, the second epitope, and the third epitope are not the same. In certain embodiments, a quadraspecific antibody provided herein comprises a first binding domain comprising a CD4 antibody provided herein that binds to a first CD4 epitope, a second binding domain that binds to a second epitope, a third binding domain that binds to a third epitope, and a fourth binding domain that binds to a fourth epitope, wherein the first CD4 epitope, the second epitope, the third epitope, and the fourth epitope are not the same. In certain embodiments, a multispecific antibody provided herein comprises a first binding domain comprising a CD4 antibody provided herein that binds to a first CD4 antigen, and a second binding domain that binds to a second antigen, wherein the first CD4 antigen and the second antigen are not the same. In certain embodiments, a bispecific antibody provided herein comprises a first binding domain comprising a CD4 antibody provided herein that binds to a first CD4 antigen, and a second binding domain that binds to a second antigen, wherein the first CD4 antigen and the second antigen are not the same. In certain embodiments, a trispecific antibody provided herein comprises a first binding domain comprising a CD4 antibody provided herein that binds to a first CD4 antigen, a second binding domain that binds to a second antigen, and a third binding domain that binds to a third antigen, wherein the first CD4 antigen, the second antigen, and the third antigen are not the same. In certain embodiments, a quadraspecific antibody provided herein comprises a first binding domain comprising a CD4 antibody provided herein that binds to a first CD4 antigen, a second binding domain that binds to a second antigen, a third binding domain that binds to a third antigen, and a fourth binding domain that binds to a fourth antigen, wherein the first CD4 antigen, the second antigen, the third antigen, and the fourth antigen are not the same. In a specific embodiment, a CD4 antibody, or antigen binding fragment thereof, provided herein specifically binds to CD4.

In some embodiments, the multispecific antibody comprises heavy chain variable regions and light chain variable region. In some embodiments, the first binding domain comprises a heavy chain variable region and a light chain variable region. In some embodiments, the second binding domain comprises a heavy chain variable region and a light chain variable region. In some embodiments, the first binding domain comprises a heavy chain variable region and a light chain variable region, and the second binding domain comprises a heavy chain variable region and a light chain variable region. In a some embodiments, the CD4 antibody is not a single domain antibody or nanobody. In some embodiments, the third binding domain comprises a heavy chain variable region and a light chain variable region. In some embodiments, the fourth binding domain comprises a heavy chain variable region and a light chain variable region.

In certain embodiments, the CD4 multispecific antibodies or antigen binding fragments thereof bind to a first epitope located on CD4 and a second epitope of a second target antigen. In some embodiments, provided herein is a multispecific antibody comprising: (a) a first binding domain that binds to a CD4 antigen, and (b) a second binding domain that binds to a second target antigen. In some embodiments, provided herein is a multispecific antibody comprising: (a) a first binding domain that specifically binds to a CD4 antigen, and (b) a second binding domain that specifically binds to a second target antigen. In some embodiments, provided herein is a multispecific antibody comprising: (a) a first binding domain that binds to a first epitope on a CD4 antigen, and (b) a second binding domain that binds to a second epitope on a second target antigen. In some embodiments, provided herein is a multispecific antibody comprising: (a) a first binding domain that specifically binds to a first epitope on a CD4 antigen, and (b) a second binding domain that specifically binds to a second epitope on a second target antigen.

In specific embodiments, the CD4 antigen is on the surface of a T cell. In certain embodiments, the second target antigen is not CD4. The binding of the CD4 multispecific antibody to CD4 present on the surface of the T cell, and the binding of the second target antigen present on the surface of the second target cell can, for example, result in the killing of the second target cell. In other embodiment, the binding of the CD4 multispecific antibody to CD4 present on the surface of the T cell, and the binding of the second target antigen can, for example, result in the activation of the T cell.

In another aspect, provided herein is a multispecific CD4/CD8 antibody. In some embodiments, the multispecific CD4/CD8 antibody is a bispecific antibody. In some embodiments, the multispecific CD4/CD8 antibody is a trispecific antibody. In some embodiments, the multispecific CD4/CD8 antibody is a quadraspecific antibody.

In one embodiment, the multispecific CD4/CD8 antibody comprises: (a) a first binding domain that binds CD8, and (b) a second binding domain that binds to CD4. In one embodiment, the multispecific CD4/CD8 antibody comprises: (a) a first binding domain that binds CD8, and (b) a second binding domain that binds to CD4, and (c) a third binding domain that binds to a third target. In one embodiment, the multispecific CD4/CD8 antibody comprises: (a) a first binding domain that binds CD8, and (b) a second binding domain that binds to CD4, (c) a third binding domain that binds to a third target, and (d) a fourth binding domain that binds to a fourth target.

In one embodiment of the multispecific CD4/CD8 antibodies provided herein, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:31; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:32. In one embodiment of the multispecific CD4/CD8 antibodies provided herein, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:65; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:66. In one embodiment of the multispecific CD4/CD8 antibodies provided herein, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:99; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:100. In one embodiment of the multispecific CD4/CD8 antibodies provided herein, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:133; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:134. In one embodiment of the multispecific CD4/CD8 antibodies provided herein, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:167; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:168. In one embodiment of the multispecific CD4/CD8 antibodies provided herein, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:201; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:202. In one embodiment of the multispecific CD4/CD8 antibodies provided herein, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:235; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:236. In one embodiment of the multispecific CD4/CD8 antibodies provided herein, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:269; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:270. In one embodiment of the multispecific CD4/CD8 antibodies provided herein, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:303; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:304. In one embodiment of the multispecific CD4/CD8 antibodies provided herein, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:337; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:338. In one embodiment of the multispecific CD4/CD8 antibodies provided herein, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:371; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:372. In one embodiment of the multispecific CD4/CD8 antibodies provided herein, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:405; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:406. In one embodiment of the multispecific CD4/CD8 antibodies provided herein, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:439; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:440. In one embodiment of the multispecific CD4/CD8 antibodies provided herein, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:473; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:474. In one embodiment of the multispecific CD4/CD8 antibodies provided herein, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:507; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:508. In one embodiment of the multispecific CD4/CD8 antibodies provided herein, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:541; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:542. In one embodiment of the multispecific CD4/CD8 antibodies provided herein, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:575; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:576. In one embodiment of the multispecific CD4/CD8 antibodies provided herein, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:609; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:610. In one embodiment of the multispecific CD4/CD8 antibodies provided herein, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:643; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:644. In one embodiment of the multispecific CD4/CD8 antibodies provided herein, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:677; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:678. In one embodiment of the multispecific CD4/CD8 antibodies provided herein, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:711; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:712. In one embodiment of the multispecific CD4/CD8 antibodies provided herein, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:745; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:746. In one embodiment of the multispecific CD4/CD8 antibodies provided herein, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:779; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:780. In one embodiment of the multispecific CD4/CD8 antibodies provided herein, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:813; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:814. In one embodiment of the multispecific CD4/CD8 antibodies provided herein, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:847; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:848. In one embodiment of the multispecific CD4/CD8 antibodies provided herein, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:881; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:882. In one embodiment of the multispecific CD4/CD8 antibodies provided herein, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:915; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:916. In one embodiment of the multispecific CD4/CD8 antibodies provided herein, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:949; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:950. In one embodiment of the multispecific CD4/CD8 antibodies provided herein, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:983; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:984. In one embodiment of the multispecific CD4/CD8 antibodies provided herein, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1017; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1018. In one embodiment of the multispecific CD4/CD8 antibodies provided herein, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1051; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1052. In one embodiment of the multispecific CD4/CD8 antibodies provided herein, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1085; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1086. In one embodiment of the multispecific CD4/CD8 antibodies provided herein, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1119; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1120. In one embodiment of the multispecific CD4/CD8 antibodies provided herein, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1153; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1154. In one embodiment of the multispecific CD4/CD8 antibodies provided herein, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1187; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1188. In one embodiment of the multispecific CD4/CD8 antibodies provided herein, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1221; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1222. In one embodiment of the multispecific CD4/CD8 antibodies provided herein, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1255; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1256. In one embodiment of the multispecific CD4/CD8 antibodies provided herein, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1289; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1290. In one embodiment of the multispecific CD4/CD8 antibodies provided herein, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1323; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1324. In one embodiment of the multispecific CD4/CD8 antibodies provided herein, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1357; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1358. In one embodiment of the multispecific CD4/CD8 antibodies provided herein, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1391; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1392. In one embodiment of the multispecific CD4/CD8 antibodies provided herein, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1425; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1426. In one embodiment of the multispecific CD4/CD8 antibodies provided herein, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1459; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1460. In one embodiment of the multispecific CD4/CD8 antibodies provided herein, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1493; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1494. In one embodiment of the multispecific CD4/CD8 antibodies provided herein, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1527; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1528. In one embodiment of the multispecific CD4/CD8 antibodies provided herein, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1561; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1562. In one embodiment of the multispecific CD4/CD8 antibodies provided herein, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1595; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1596. In one embodiment of the multispecific CD4/CD8 antibodies provided herein, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1629; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1630. In one embodiment of the multispecific CD4/CD8 antibodies provided herein, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1663; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1664. In one embodiment of the multispecific CD4/CD8 antibodies provided herein, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1697; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1698. In one embodiment of the multispecific CD4/CD8 antibodies provided herein, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1731; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1732. In one embodiment of the multispecific CD4/CD8 antibodies provided herein, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1765; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1766. In one embodiment of the multispecific CD4/CD8 antibodies provided herein, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1799; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1800. In one embodiment of the multispecific CD4/CD8 antibodies provided herein, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1833; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1834. In one embodiment of the multispecific CD4/CD8 antibodies provided herein, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1867; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1868. In one embodiment of the multispecific CD4/CD8 antibodies provided herein, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1901; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1902. In one embodiment of the multispecific CD4/CD8 antibodies provided herein, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1935; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1936. In one embodiment of the multispecific CD4/CD8 antibodies provided herein, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1969; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1970. In one embodiment of the multispecific CD4/CD8 antibodies provided herein, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2003; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2004. In another aspect, provided herein is an antibody that binds CD8. In one embodiment of the multispecific CD4/CD8 antibodies provided herein, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2037; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2038. In one embodiment of the multispecific CD4/CD8 antibodies provided herein, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2071; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2072. In one embodiment of the multispecific CD4/CD8 antibodies provided herein, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2105; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2106. In one embodiment of the multispecific CD4/CD8 antibodies provided herein, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2139; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2140. In one embodiment of the multispecific CD4/CD8 antibodies provided herein, the first binding domain that binds CD8 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2173; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2174.

In some embodiments of the multispecific CD4/CD8 antibodies provided herein, the VH CDR1, VH CDR2, VH CDR3, VL CDR1, VL CDR2, and VL CDR3 amino acid sequences of the first binding domain that binds CD8 are according to the Kabat numbering system. In some embodiments of the multispecific CD4/CD8 antibodies provided herein, the VH CDR1, VH CDR2, VH CDR3, VL CDR1, VL CDR2, and VL CDR3 amino acid sequences of the first binding domain that binds CD8 are according to the Chothia numbering system. In some embodiments of the multispecific CD4/CD8 antibodies provided herein, the VH CDR1, VH CDR2, VH CDR3, VL CDR1, VL CDR2, and VL CDR3 amino acid sequences of the first binding domain that binds CD8 are according to the AbM numbering system. In some embodiments of the multispecific CD4/CD8 antibodies provided herein, the VH CDR1, VH CDR2, VH CDR3, VL CDR1, VL CDR2, and VL CDR3 amino acid sequences of the first binding domain that binds CD8 are according to the Contact numbering system. In some embodiments of the multispecific CD4/CD8 antibodies provided herein, the VH CDR1, VH CDR2, VH CDR3, VL CDR1, VL CDR2, and VL CDR3 amino acid sequences of the first binding domain that binds CD8 are according to the IMGT numbering system.

In some embodiments of the multispecific CD4/CD8 antibodies provided herein, the first binding domain binds a CD8 antigen. In some embodiments of the multispecific CD4/CD8 antibodies provided herein, the first binding domain binds a CD8 epitope. In some embodiments of the multispecific CD4/CD8 antibodies provided herein, the first binding domain specifically binds to CD8. In some embodiments of the multispecific CD4/CD8 antibodies provided herein, the VH CDR1, VH CDR2, VH CDR3, VL CDR1, VL CDR2 and VL CDR3 of the first binding domain form a binding site for an antigen of the CD8. In some embodiments of the multispecific CD4/CD8 antibodies provided herein, the VH CDR1, VH CDR2, VH CDR3, VL CDR1, VL CDR2 and VL CDR3 of the first binding domain form a binding site for an epitope of the CD8. In some embodiments of the multispecific CD4/CD8 antibodies provided herein, the CD8 is present on the surface of a T cell. In some embodiments of the multispecific CD4/CD8 antibodies provided herein, the first binding domain binds to CD8α. In some embodiments of the multispecific CD4/CD8 antibodies provided herein, the first binding domain binds a CD8α antigen. In some embodiments of the multispecific CD4/CD8 antibodies provided herein, the first binding domain that binds a CD8α epitope. In some embodiments of the multispecific CD4/CD8 antibodies provided herein, the first binding domain specifically binds to CD8α. In some embodiments of the multispecific CD4/CD8 antibodies provided herein, the VH CDR1, VH CDR2, VH CDR3, VL CDR1, VL CDR2 and VL CDR3 of the first binding domain form a binding site for an antigen of the CD8α. In some embodiments of the multispecific CD4/CD8 antibodies provided herein, the VH CDR1, VH CDR2, VH CDR3, VL CDR1, VL CDR2 and VL CDR3 of the first binding domain form a binding site for an epitope of the CD8α. In some embodiments of the multispecific CD4/CD8 antibodies provided herein, the CD8α is present on the surface of a T cell. In some embodiments of the multispecific CD4/CD8 antibodies provided herein, the first binding domain binds to CD8β. In some embodiments of the multispecific CD4/CD8 antibodies provided herein, the first binding domain binds a CD8β antigen. In some embodiments of the multispecific CD4/CD8 antibodies provided herein, the first binding domain that binds a CD8β epitope. In some embodiments of the multispecific CD4/CD8 antibodies provided herein, the first binding domain specifically binds to CD8β. In some embodiments of the multispecific CD4/CD8 antibodies provided herein, the VH CDR1, VH CDR2, VH CDR3, VL CDR1, VL CDR2 and VL CDR3 of the first binding domain form a binding site for an antigen of the CD8β. In some embodiments of the multispecific CD4/CD8 antibodies provided herein, the VH CDR1, VH CDR2, VH CDR3, VL CDR1, VL CDR2 and VL CDR3 of the first binding domain form a binding site for an epitope of the CD8β. In some embodiments of the multispecific CD4/CD8 antibodies provided herein, the CD8β is present on the surface of a T cell. In some embodiments of the multispecific CD4/CD8 antibodies provided herein, the first binding domain binds at the interface of CD8α and CD8β. In some embodiments of the multispecific CD4/CD8 antibodies provided herein, the first binding domain binds an antigen at the interface of CD8α and CD8β. In some embodiments of the multispecific CD4/CD8 antibodies provided herein, first binding domain binds an epitope at the interface of CD8α and CD8β. In some embodiments of the multispecific CD4/CD8 antibodies provided herein, the first binding domain specifically binds at the interface of CD8α and CD8β. In some embodiments of the multispecific CD4/CD8 antibodies provided herein, the VH CDR1, VH CDR2, VH CDR3, VL CDR1, VL CDR2 and VL CDR3 of the first binding domain form a binding site for an antigen at the interface of CD8α and CD8β. In some embodiments of the multispecific CD4/CD8 antibodies provided herein, the VH CDR1, VH CDR2, VH CDR3, VL CDR1, VL CDR2 and VL CDR3 of the first binding domain form a binding site for an epitope at the interface of CD8α and CD8β. In some embodiments of the multispecific CD4/CD8 antibodies provided herein, the interface of CD8α and CD8β is present on the surface of a T cell.

In some embodiments of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:2207; and (ii) a VL comprising a VL CDR1, a VL CDR2, and a VL CDR3 having an amino acid sequence of a VL CDR1, a VL CDR2, and a VL CDR3, respectively, of SEQ ID NO:2208. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:2241; and (ii) a VL comprising a VL CDR1, a VL CDR2, and a VL CDR3 having an amino acid sequence of a VL CDR1, a VL CDR2, and a VL CDR3, respectively, of SEQ ID NO:2242. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:2275; and (ii) a VL comprising a VL CDR1, a VL CDR2, and a VL CDR3 having an amino acid sequence of a VL CDR1, a VL CDR2, and a VL CDR3, respectively, of SEQ ID NO:2276. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:2309; and (ii) a VL comprising a VL CDR1, a VL CDR2, and a VL CDR3 having an amino acid sequence of a VL CDR1, a VL CDR2, and a VL CDR3, respectively, of SEQ ID NO:2310. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:2343; and (ii) a VL comprising a VL CDR1, a VL CDR2, and a VL CDR3 having an amino acid sequence of a VL CDR1, a VL CDR2, and a VL CDR3, respectively, of SEQ ID NO:2344. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:2377; and (ii) a VL comprising a VL CDR1, a VL CDR2, and a VL CDR3 having an amino acid sequence of a VL CDR1, a VL CDR2, and a VL CDR3, respectively, of SEQ ID NO:2378. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:2411; and (ii) a VL comprising a VL CDR1, a VL CDR2, and a VL CDR3 having an amino acid sequence of a VL CDR1, a VL CDR2, and a VL CDR3, respectively, of SEQ ID NO:2412. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:2445; and (ii) a VL comprising a VL CDR1, a VL CDR2, and a VL CDR3 having an amino acid sequence of a VL CDR1, a VL CDR2, and a VL CDR3, respectively, of SEQ ID NO:2446. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:2479; and (ii) a VL comprising a VL CDR1, a VL CDR2, and a VL CDR3 having an amino acid sequence of a VL CDR1, a VL CDR2, and a VL CDR3, respectively, of SEQ ID NO:2480. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:2513; and (ii) a VL comprising a VL CDR1, a VL CDR2, and a VL CDR3 having an amino acid sequence of a VL CDR1, a VL CDR2, and a VL CDR3, respectively, of SEQ ID NO:2514. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:2547; and (ii) a VL comprising a VL CDR1, a VL CDR2, and a VL CDR3 having an amino acid sequence of a VL CDR1, a VL CDR2, and a VL CDR3, respectively, of SEQ ID NO:2548. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:2581; and (ii) a VL comprising a VL CDR1, a VL CDR2, and a VL CDR3 having an amino acid sequence of a VL CDR1, a VL CDR2, and a VL CDR3, respectively, of SEQ ID NO:2582. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:2615; and (ii) a VL comprising a VL CDR1, a VL CDR2, and a VL CDR3 having an amino acid sequence of a VL CDR1, a VL CDR2, and a VL CDR3, respectively, of SEQ ID NO:2616. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:2649; and (ii) a VL comprising a VL CDR1, a VL CDR2, and a VL CDR3 having an amino acid sequence of a VL CDR1, a VL CDR2, and a VL CDR3, respectively, of SEQ ID NO:2650. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:2683; and (ii) a VL comprising a VL CDR1, a VL CDR2, and a VL CDR3 having an amino acid sequence of a VL CDR1, a VL CDR2, and a VL CDR3, respectively, of SEQ ID NO:2684. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:2717; and (ii) a VL comprising a VL CDR1, a VL CDR2, and a VL CDR3 having an amino acid sequence of a VL CDR1, a VL CDR2, and a VL CDR3, respectively, of SEQ ID NO:2718. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:2751; and (ii) a VL comprising a VL CDR1, a VL CDR2, and a VL CDR3 having an amino acid sequence of a VL CDR1, a VL CDR2, and a VL CDR3, respectively, of SEQ ID NO:2752. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:2785; and (ii) a VL comprising a VL CDR1, a VL CDR2, and a VL CDR3 having an amino acid sequence of a VL CDR1, a VL CDR2, and a VL CDR3, respectively, of SEQ ID NO:2786. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:2819; and (ii) a VL comprising a VL CDR1, a VL CDR2, and a VL CDR3 having an amino acid sequence of a VL CDR1, a VL CDR2, and a VL CDR3, respectively, of SEQ ID NO:2820. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:2853; and (ii) a VL comprising a VL CDR1, a VL CDR2, and a VL CDR3 having an amino acid sequence of a VL CDR1, a VL CDR2, and a VL CDR3, respectively, of SEQ ID NO:2854. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:2887; and (ii) a VL comprising a VL CDR1, a VL CDR2, and a VL CDR3 having an amino acid sequence of a VL CDR1, a VL CDR2, and a VL CDR3, respectively, of SEQ ID NO:2888. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:2921; and (ii) a VL comprising a VL CDR1, a VL CDR2, and a VL CDR3 having an amino acid sequence of a VL CDR1, a VL CDR2, and a VL CDR3, respectively, of SEQ ID NO:2922. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:2955; and (ii) a VL comprising a VL CDR1, a VL CDR2, and a VL CDR3 having an amino acid sequence of a VL CDR1, a VL CDR2, and a VL CDR3, respectively, of SEQ ID NO:2956. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:2989; and (ii) a VL comprising a VL CDR1, a VL CDR2, and a VL CDR3 having an amino acid sequence of a VL CDR1, a VL CDR2, and a VL CDR3, respectively, of SEQ ID NO:2990. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:3023; and (ii) a VL comprising a VL CDR1, a VL CDR2, and a VL CDR3 having an amino acid sequence of a VL CDR1, a VL CDR2, and a VL CDR3, respectively, of SEQ ID NO:3024. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:3057; and (ii) a VL comprising a VL CDR1, a VL CDR2, and a VL CDR3 having an amino acid sequence of a VL CDR1, a VL CDR2, and a VL CDR3, respectively, of SEQ ID NO:3058. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:3091; and (ii) a VL comprising a VL CDR1, a VL CDR2, and a VL CDR3 having an amino acid sequence of a VL CDR1, a VL CDR2, and a VL CDR3, respectively, of SEQ ID NO:3092. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:3125; and (ii) a VL comprising a VL CDR1, a VL CDR2, and a VL CDR3 having an amino acid sequence of a VL CDR1, a VL CDR2, and a VL CDR3, respectively, of SEQ ID NO:3126. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:3159; and (ii) a VL comprising a VL CDR1, a VL CDR2, and a VL CDR3 having an amino acid sequence of a VL CDR1, a VL CDR2, and a VL CDR3, respectively, of SEQ ID NO:3160. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:3193; and (ii) a VL comprising a VL CDR1, a VL CDR2, and a VL CDR3 having an amino acid sequence of a VL CDR1, a VL CDR2, and a VL CDR3, respectively, of SEQ ID NO:3194. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:3227; and (ii) a VL comprising a VL CDR1, a VL CDR2, and a VL CDR3 having an amino acid sequence of a VL CDR1, a VL CDR2, and a VL CDR3, respectively, of SEQ ID NO:3228. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:3261; and (ii) a VL comprising a VL CDR1, a VL CDR2, and a VL CDR3 having an amino acid sequence of a VL CDR1, a VL CDR2, and a VL CDR3, respectively, of SEQ ID NO:3262. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:3295; and (ii) a VL comprising a VL CDR1, a VL CDR2, and a VL CDR3 having an amino acid sequence of a VL CDR1, a VL CDR2, and a VL CDR3, respectively, of SEQ ID NO:3296. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:3329; and (ii) a VL comprising a VL CDR1, a VL CDR2, and a VL CDR3 having an amino acid sequence of a VL CDR1, a VL CDR2, and a VL CDR3, respectively, of SEQ ID NO:3330. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:3363; and (ii) a VL comprising a VL CDR1, a VL CDR2, and a VL CDR3 having an amino acid sequence of a VL CDR1, a VL CDR2, and a VL CDR3, respectively, of SEQ ID NO:3364. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:3397; and (ii) a VL comprising a VL CDR1, a VL CDR2, and a VL CDR3 having an amino acid sequence of a VL CDR1, a VL CDR2, and a VL CDR3, respectively, of SEQ ID NO:3398. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:3431; and (ii) a VL comprising a VL CDR1, a VL CDR2, and a VL CDR3 having an amino acid sequence of a VL CDR1, a VL CDR2, and a VL CDR3, respectively, of SEQ ID NO:3432. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:3465; and (ii) a VL comprising a VL CDR1, a VL CDR2, and a VL CDR3 having an amino acid sequence of a VL CDR1, a VL CDR2, and a VL CDR3, respectively, of SEQ ID NO:3466. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:3499; and (ii) a VL comprising a VL CDR1, a VL CDR2, and a VL CDR3 having an amino acid sequence of a VL CDR1, a VL CDR2, and a VL CDR3, respectively, of SEQ ID NO:3500. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:3533; and (ii) a VL comprising a VL CDR1, a VL CDR2, and a VL CDR3 having an amino acid sequence of a VL CDR1, a VL CDR2, and a VL CDR3, respectively, of SEQ ID NO:3534. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:3567; and (ii) a VL comprising a VL CDR1, a VL CDR2, and a VL CDR3 having an amino acid sequence of a VL CDR1, a VL CDR2, and a VL CDR3, respectively, of SEQ ID NO:3568. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:3601; and (ii) a VL comprising a VL CDR1, a VL CDR2, and a VL CDR3 having an amino acid sequence of a VL CDR1, a VL CDR2, and a VL CDR3, respectively, of SEQ ID NO:3602. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:3635; and (ii) a VL comprising a VL CDR1, a VL CDR2, and a VL CDR3 having an amino acid sequence of a VL CDR1, a VL CDR2, and a VL CDR3, respectively, of SEQ ID NO:3636. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:3669; and (ii) a VL comprising a VL CDR1, a VL CDR2, and a VL CDR3 having an amino acid sequence of a VL CDR1, a VL CDR2, and a VL CDR3, respectively, of SEQ ID NO:3670. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:3703; and (ii) a VL comprising a VL CDR1, a VL CDR2, and a VL CDR3 having an amino acid sequence of a VL CDR1, a VL CDR2, and a VL CDR3, respectively, of SEQ ID NO:3704. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:3737; and (ii) a VL comprising a VL CDR1, a VL CDR2, and a VL CDR3 having an amino acid sequence of a VL CDR1, a VL CDR2, and a VL CDR3, respectively, of SEQ ID NO:3738. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:3771; and (ii) a VL comprising a VL CDR1, a VL CDR2, and a VL CDR3 having an amino acid sequence of a VL CDR1, a VL CDR2, and a VL CDR3, respectively, of SEQ ID NO:3772. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:3805; and (ii) a VL comprising a VL CDR1, a VL CDR2, and a VL CDR3 having an amino acid sequence of a VL CDR1, a VL CDR2, and a VL CDR3, respectively, of SEQ ID NO:3806. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:3839; and (ii) a VL comprising a VL CDR1, a VL CDR2, and a VL CDR3 having an amino acid sequence of a VL CDR1, a VL CDR2, and a VL CDR3, respectively, of SEQ ID NO:3840. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:3873; and (ii) a VL comprising a VL CDR1, a VL CDR2, and a VL CDR3 having an amino acid sequence of a VL CDR1, a VL CDR2, and a VL CDR3, respectively, of SEQ ID NO:3874. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:3907; and (ii) a VL comprising a VL CDR1, a VL CDR2, and a VL CDR3 having an amino acid sequence of a VL CDR1, a VL CDR2, and a VL CDR3, respectively, of SEQ ID NO:3908. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:3941; and (ii) a VL comprising a VL CDR1, a VL CDR2, and a VL CDR3 having an amino acid sequence of a VL CDR1, a VL CDR2, and a VL CDR3, respectively, of SEQ ID NO:3942. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:3975; and (ii) a VL comprising a VL CDR1, a VL CDR2, and a VL CDR3 having an amino acid sequence of a VL CDR1, a VL CDR2, and a VL CDR3, respectively, of SEQ ID NO:3976. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:4009; and (ii) a VL comprising a VL CDR1, a VL CDR2, and a VL CDR3 having an amino acid sequence of a VL CDR1, a VL CDR2, and a VL CDR3, respectively, of SEQ ID NO:4010. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:4043; and (ii) a VL comprising a VL CDR1, a VL CDR2, and a VL CDR3 having an amino acid sequence of a VL CDR1, a VL CDR2, and a VL CDR3, respectively, of SEQ ID NO:4044. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:4077; and (ii) a VL comprising a VL CDR1, a VL CDR2, and a VL CDR3 having an amino acid sequence of a VL CDR1, a VL CDR2, and a VL CDR3, respectively, of SEQ ID NO:4078. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:4111; and (ii) a VL comprising a VL CDR1, a VL CDR2, and a VL CDR3 having an amino acid sequence of a VL CDR1, a VL CDR2, and a VL CDR3, respectively, of SEQ ID NO:4112. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:4145; and (ii) a VL comprising a VL CDR1, a VL CDR2, and a VL CDR3 having an amino acid sequence of a VL CDR1, a VL CDR2, and a VL CDR3, respectively, of SEQ ID NO:4146. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:4179; and (ii) a VL comprising a VL CDR1, a VL CDR2, and a VL CDR3 having an amino acid sequence of a VL CDR1, a VL CDR2, and a VL CDR3, respectively, of SEQ ID NO:4180. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:4213; and (ii) a VL comprising a VL CDR1, a VL CDR2, and a VL CDR3 having an amino acid sequence of a VL CDR1, a VL CDR2, and a VL CDR3, respectively, of SEQ ID NO:4214. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:4247; and (ii) a VL comprising a VL CDR1, a VL CDR2, and a VL CDR3 having an amino acid sequence of a VL CDR1, a VL CDR2, and a VL CDR3, respectively, of SEQ ID NO:4248. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:4281; and (ii) a VL comprising a VL CDR1, a VL CDR2, and a VL CDR3 having an amino acid sequence of a VL CDR1, a VL CDR2, and a VL CDR3, respectively, of SEQ ID NO:4282. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:4315; and (ii) a VL comprising a VL CDR1, a VL CDR2, and a VL CDR3 having an amino acid sequence of a VL CDR1, a VL CDR2, and a VL CDR3, respectively, of SEQ ID NO:4316. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:4349; and (ii) a VL comprising a VL CDR1, a VL CDR2, and a VL CDR3 having an amino acid sequence of a VL CDR1, a VL CDR2, and a VL CDR3, respectively, of SEQ ID NO:4350. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:4383; and (ii) a VL comprising a VL CDR1, a VL CDR2, and a VL CDR3 having an amino acid sequence of a VL CDR1, a VL CDR2, and a VL CDR3, respectively, of SEQ ID NO:4384. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:4417; and (ii) a VL comprising a VL CDR1, a VL CDR2, and a VL CDR3 having an amino acid sequence of a VL CDR1, a VL CDR2, and a VL CDR3, respectively, of SEQ ID NO:4418. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:4451; and (ii) a VL comprising a VL CDR1, a VL CDR2, and a VL CDR3 having an amino acid sequence of a VL CDR1, a VL CDR2, and a VL CDR3, respectively, of SEQ ID NO:4452. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:4485; and (ii) a VL comprising a VL CDR1, a VL CDR2, and a VL CDR3 having an amino acid sequence of a VL CDR1, a VL CDR2, and a VL CDR3, respectively, of SEQ ID NO:4486. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:4519; and (ii) a VL comprising a VL CDR1, a VL CDR2, and a VL CDR3 having an amino acid sequence of a VL CDR1, a VL CDR2, and a VL CDR3, respectively, of SEQ ID NO:4520. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:4553; and (ii) a VL comprising a VL CDR1, a VL CDR2, and a VL CDR3 having an amino acid sequence of a VL CDR1, a VL CDR2, and a VL CDR3, respectively, of SEQ ID NO:4554. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:4587; and (ii) a VL comprising a VL CDR1, a VL CDR2, and a VL CDR3 having an amino acid sequence of a VL CDR1, a VL CDR2, and a VL CDR3, respectively, of SEQ ID NO:4588. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:4621; and (ii) a VL comprising a VL CDR1, a VL CDR2, and a VL CDR3 having an amino acid sequence of a VL CDR1, a VL CDR2, and a VL CDR3, respectively, of SEQ ID NO:4622. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:4655; and (ii) a VL comprising a VL CDR1, a VL CDR2, and a VL CDR3 having an amino acid sequence of a VL CDR1, a VL CDR2, and a VL CDR3, respectively, of SEQ ID NO:4656. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:4689; and (ii) a VL comprising a VL CDR1, a VL CDR2, and a VL CDR3 having an amino acid sequence of a VL CDR1, a VL CDR2, and a VL CDR3, respectively, of SEQ ID NO:4690. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:4723; and (ii) a VL comprising a VL CDR1, a VL CDR2, and a VL CDR3 having an amino acid sequence of a VL CDR1, a VL CDR2, and a VL CDR3, respectively, of SEQ ID NO:4724. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:4757; and (ii) a VL comprising a VL CDR1, a VL CDR2, and a VL CDR3 having an amino acid sequence of a VL CDR1, a VL CDR2, and a VL CDR3, respectively, of SEQ ID NO:4758. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:4791; and (ii) a VL comprising a VL CDR1, a VL CDR2, and a VL CDR3 having an amino acid sequence of a VL CDR1, a VL CDR2, and a VL CDR3, respectively, of SEQ ID NO:4792. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:4825; and (ii) a VL comprising a VL CDR1, a VL CDR2, and a VL CDR3 having an amino acid sequence of a VL CDR1, a VL CDR2, and a VL CDR3, respectively, of SEQ ID NO:4826. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:4859; and (ii) a VL comprising a VL CDR1, a VL CDR2, and a VL CDR3 having an amino acid sequence of a VL CDR1, a VL CDR2, and a VL CDR3, respectively, of SEQ ID NO:4860. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:4893; and (ii) a VL comprising a VL CDR1, a VL CDR2, and a VL CDR3 having an amino acid sequence of a VL CDR1, a VL CDR2, and a VL CDR3, respectively, of SEQ ID NO:4894. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:4927; and (ii) a VL comprising a VL CDR1, a VL CDR2, and a VL CDR3 having an amino acid sequence of a VL CDR1, a VL CDR2, and a VL CDR3, respectively, of SEQ ID NO:4928. In one embodiment of the multispecific CD4/CD8 antibodies provided herein, the second binding domain that binds CD4 comprises: (i) a VH comprising a VH CDR1, a VH CDR2, and a VH CDR3 having an amino acid sequence of a VH CDR1, a VH CDR2, and a VH CDR3, respectively, of SEQ ID NO:4961; and (ii) a VL comprising a VL CDR1, a VL CDR2, and a VL CDR3 having an amino acid sequence of a VL CDR1, a VL CDR2, and a VL CDR3, respectively, of SEQ ID NO:4962.

In some embodiments of the multispecific CD4/CD8 antibodies provided herein, the VH CDR1, VH CDR2, VH CDR3, VL CDR1, VL CDR2, and VL CDR3 amino acid sequences of the second binding domain that binds CD4 are according to the Kabat numbering system. In some embodiments of the multispecific CD4/CD8 antibodies provided herein, the VH CDR1, VH CDR2, VH CDR3, VL CDR1, VL CDR2, and VL CDR3 amino acid sequences of the second binding domain that binds CD4 are according to the Chothia numbering system. In some embodiments of the multispecific CD4/CD8 antibodies provided herein, the VH CDR1, VH CDR2, VH CDR3, VL CDR1, VL CDR2, and VL CDR3 amino acid sequences of the second binding domain that binds CD4 are according to the AbM numbering system. In some embodiments of the multispecific CD4/CD8 antibodies provided herein, the VH CDR1, VH CDR2, VH CDR3, VL CDR1, VL CDR2, and VL CDR3 amino acid sequences of the second binding domain that binds CD4 are according to the Contact numbering system. In some embodiments of the multispecific CD4/CD8 antibodies provided herein, the VH CDR1, VH CDR2, VH CDR3, VL CDR1, VL CDR2, and VL CDR3 amino acid sequences of the second binding domain that binds CD4 are according to the IMGT numbering system.

In some embodiments of the multispecific CD4/CD8 antibodies provided herein, the second binding domain binds a CD4 antigen. In some embodiments of the multispecific CD4/CD8 antibodies provided herein, the second binding domain binds a CD4 epitope. In some embodiments of the multispecific CD4/CD8 antibodies provided herein, the second binding domain specifically binds to CD4. In some embodiments of the multispecific CD4/CD8 antibodies provided herein, the VH CDR1, VH CDR2, VH CDR3, VL CDR1, VL CDR2 and VL CDR3 of the second binding domain form a binding site for an antigen of the CD4. In some embodiments, the VH CDR1, VH CDR2, VH CDR3, VL CDR1, VL CDR2 and VL CDR3 of the second binding domain form a binding site for an epitope of the CD4. In some embodiments, the CD4 is present on the surface of a T cell.

In some embodiments of the multispecific CD4/CD8 antibodies provided herein, the third target is not a CD8 antigen. In some embodiments of the multispecific CD4/CD8 antibodies provided herein, the fourth target is not a CD8 antigen. In some embodiments of the multispecific CD4/CD8 antibodies provided herein, the third target is not a CD8 antigen, and the fourth target is not a CD8 antigen. In some embodiments of the multispecific CD4/CD8 antibodies provided herein, the third target is not a CD4 antigen. In some embodiments of the multispecific CD4/CD8 antibodies provided herein, the fourth target is not a CD4 antigen. In some embodiments of the multispecific CD4/CD8 antibodies provided herein, the third target is not a CD4 antigen, and the fourth target is not a CD4 antigen. In some embodiments of the multispecific CD4/CD8 antibodies provided herein, the third target is not a CD8 epitope. In some embodiments of the multispecific CD4/CD8 antibodies provided herein, the fourth target is not a CD8 epitope. In some embodiments of the multispecific CD4/CD8 antibodies provided herein, the third target is not a CD8 epitope, and the fourth target is not a CD8 epitope. In some embodiments of the multispecific CD4/CD8 antibodies provided herein, the third target is not a CD4 epitope. In some embodiments of the multispecific CD4/CD8 antibodies provided herein, the fourth target is not a CD4 epitope. In some embodiments of the multispecific CD4/CD8 antibodies provided herein, the third target is not a CD4 epitope, and the fourth target is not a CD4 epitope.

In some embodiments of the multispecific CD4/CD8 antibodies provided herein, the third target is a TCR complex. In some embodiments of the multispecific CD4/CD8 antibodies provided herein, the third target is CD3. In some embodiments of the multispecific CD4/CD8 antibodies provided herein, the third target is CD3ε. In some embodiments of the multispecific CD4/CD8 antibodies provided herein, the third target is CD3γ. In some embodiments of the multispecific CD4/CD8 antibodies provided herein, the third target is CD3δ. In some embodiments of the multispecific CD4/CD8 antibodies provided herein, the third target is CD3ζ. In some embodiments of the multispecific CD4/CD8 antibodies provided herein, the third target is a TCRα chain. In some embodiments of the multispecific CD4/CD8 antibodies provided herein, the third target is a TCRβ chain. In some embodiments of the multispecific CD4/CD8 antibodies provided herein, the third target is a TCRγ chain. In some embodiments of the multispecific CD4/CD8 antibodies provided herein, the third target is a TCRδ chain. In some embodiments of the multispecific CD4/CD8 antibodies provided herein, the third target is a T cell costimulatory molecule. In some embodiments of the multispecific CD4/CD8 antibodies provided herein, the third target is CD28. In some embodiments of the multispecific CD4/CD8 antibodies provided herein, the third target is CTLA4. In some embodiments of the multispecific CD4/CD8 antibodies provided herein, the third target is ICOS. In some embodiments of the multispecific CD4/CD8 antibodies provided herein, the third target is 4-1BB. In some embodiments of the multispecific CD4/CD8 antibodies provided herein, the third target is GITR. In some embodiments of the multispecific CD4/CD8 antibodies provided herein, the third target is CD27. In some embodiments of the multispecific CD4/CD8 antibodies provided herein, the third target is OX40. In some embodiments of the multispecific CD4/CD8 antibodies provided herein, the third target is CD40L. In some embodiments of the multispecific CD4/CD8 antibodies provided herein, the third target is HVEM. In some embodiments of the multispecific CD4/CD8 antibodies provided herein, the third target is Galectin-9. In some embodiments of the multispecific CD4/CD8 antibodies provided herein, the third target is TIM-1. In some embodiments of the multispecific CD4/CD8 antibodies provided herein, the third target is LFA1. In some embodiments of the multispecific CD4/CD8 antibodies provided herein, the third target is CD2. In some embodiments of the multispecific CD4/CD8 antibodies provided herein, the third target is PD1.

In some embodiments of the multispecific CD4/CD8 antibodies provided herein, the fourth target is a TCR complex. In some embodiments of the multispecific CD4/CD8 antibodies provided herein, the fourth target is CD3. In some embodiments of the multispecific CD4/CD8 antibodies provided herein, the fourth target is CD3ε. In some embodiments of the multispecific CD4/CD8 antibodies provided herein, the fourth target is CD3γ. In some embodiments of the multispecific CD4/CD8 antibodies provided herein, the fourth target is CD3δ. In some embodiments of the multispecific CD4/CD8 antibodies provided herein, the fourth target is CD3ζ. In some embodiments of the multispecific CD4/CD8 antibodies provided herein, the fourth target is a TCRα chain. In some embodiments of the multispecific CD4/CD8 antibodies provided herein, the fourth target is a TCRβ chain. In some embodiments of the multispecific CD4/CD8 antibodies provided herein, the fourth target is a TCRγ chain. In some embodiments of the multispecific CD4/CD8 antibodies provided herein, the fourth target is a TCRδ chain. In some embodiments of the multispecific CD4/CD8 antibodies provided herein, the fourth target is a T cell costimulatory molecule. In some embodiments of the multispecific CD4/CD8 antibodies provided herein, the fourth target is CD28. In some embodiments of the multispecific CD4/CD8 antibodies provided herein, the fourth target is CTLA4. In some embodiments of the multispecific CD4/CD8 antibodies provided herein, the fourth target is ICOS. In some embodiments of the multispecific CD4/CD8 antibodies provided herein, the fourth target is 4-1BB. In some embodiments of the multispecific CD4/CD8 antibodies provided herein, the fourth target is GITR. In some embodiments of the multispecific CD4/CD8 antibodies provided herein, the fourth target is CD27. In some embodiments of the multispecific CD4/CD8 antibodies provided herein, the fourth target is OX40. In some embodiments of the multispecific CD4/CD8 antibodies provided herein, the fourth target is CD40L. In some embodiments of the multispecific CD4/CD8 antibodies provided herein, the fourth target is HVEM. In some embodiments of the multispecific CD4/CD8 antibodies provided herein, the fourth target is Galectin-9. In some embodiments of the multispecific CD4/CD8 antibodies provided herein, the fourth target is TIM-1. In some embodiments of the multispecific CD4/CD8 antibodies provided herein, the fourth target is LFA1. In some embodiments of the multispecific CD4/CD8 antibodies provided herein, the fourth target is CD2. In some embodiments of the multispecific CD4/CD8 antibodies provided herein, the fourth target is PD1.

In some embodiments of the multispecific CD4/CD8 antibodies provided herein, the third target is a TCR complex, and the fourth target is a T cell costimulatory molecule. In some embodiments of the multispecific CD4/CD8 antibodies provided herein, the third target is CD3, and the fourth target is a T cell costimulatory molecule. In some embodiments of the multispecific CD4/CD8 antibodies provided herein, the third target is CD3ε, and the fourth target is a T cell costimulatory molecule. In some embodiments of the multispecific CD4/CD8 antibodies provided herein, the third target is CD3γ, and the fourth target is a T cell costimulatory molecule. In some embodiments of the multispecific CD4/CD8 antibodies provided herein, the third target is CD3δ, and the fourth target is a T cell costimulatory molecule. In some embodiments of the multispecific CD4/CD8 antibodies provided herein, the third target is CD3ζ, and the fourth target is a T cell costimulatory molecule. In some embodiments of the multispecific CD4/CD8 antibodies provided herein, the third target is a TCRα chain, and the fourth target is a T cell costimulatory molecule. In some embodiments of the multispecific CD4/CD8 antibodies provided herein, the third target is a TCRβ chain, and the fourth target is a T cell costimulatory molecule. In some embodiments of the multispecific CD4/CD8 antibodies provided herein, the third target is a TCRγ chain, and the fourth target is a T cell costimulatory molecule. In certain embodiments, the T cell costimulatory molecule is CD28. In certain embodiments, the T cell costimulatory molecule is CTLA4. In certain embodiments, the T cell costimulatory molecule is ICOS. In certain embodiments, the T cell costimulatory molecule is 4-1BB. In certain embodiments, the T cell costimulatory molecule is GITR. In certain embodiments, the T cell costimulatory molecule is CD27. In certain embodiments, the T cell costimulatory molecule is OX40. In certain embodiments, the T cell costimulatory molecule is CD40L. In certain embodiments, the T cell costimulatory molecule is HVEM. In certain embodiments, the T cell costimulatory molecule is Galectin-9. In certain embodiments, the T cell costimulatory molecule is TIM-1. In certain embodiments, the T cell costimulatory molecule is LFA1. In certain embodiments, the T cell costimulatory molecule is CD2. In certain embodiments, the T cell costimulatory molecule is PD1.

In a specific embodiment, the target is from a mammal. In a specific embodiment, the target is from a rat. In a specific embodiment, the target is from a mouse. In a specific embodiment, the target is from a primate. In a specific embodiment, the target is from a human.

In specific embodiments, provided is a multispecific CD4/CD8 antibody in a knob-in-hole format. In specific embodiments, provided is a bispecific CD4/CD8 antibody in a knob-in-hole format. In specific embodiments, provided is a trispecific antibody in a knob-in-hole format. In specific embodiments, provided is a quadraspecific antibody in a knob-in-hole format. Other specificities can be added to an antibody in knob-in-hole format using methods well known in the art (e.g., adding an scFv to the N-terminus or C-terminus). In addition, other formats and methods of making multispecific antibodies are also known in the art and contemplated. In some embodiments, a CD4/CD8 antibody provided herein is comprised in a bispecific antibody. In some embodiments, a CD4/CD8 antibody provided herein is comprised in a trispecific antibody. In some embodiments, a CD4/CD8 antibody provided herein is comprised in a quadraspecific antibody. In some embodiments, a CD4/CD8 bispecific antibody provided herein is comprised in a multispecific antibody.

In certain embodiments, a trispecific CD4/CD8 antibody provided herein comprises a first binding domain comprising a CD8 antibody provided herein that binds to a CD8 epitope, a second binding domain comprising a CD4 antibody provided herein that that binds to a CD4 epitope, and a third binding domain that binds to a third epitope, wherein the CD8 epitope, the CD4 epitope, and the third epitope are not the same. In certain embodiments, a quadraspecific antibody provided herein comprises a first binding domain comprising a CD8 antibody provided herein that binds to a CD8 epitope, a second binding domain comprising a CD4 antibody provided herein that that binds to a CD4 epitope, a third binding domain that binds to a third epitope, and a fourth binding domain that binds to a fourth epitope, wherein the CD8 epitope, the CD4 epitope, the third epitope, and the fourth epitope are not the same. In certain embodiments, a trispecific antibody provided herein comprises a first binding domain comprising a CD8 antibody provided herein that binds to a CD8 antigen, a second binding domain comprising a CD4 antibody provided herein that that binds to a CD4 antigen, and a third binding domain that binds to a third antigen, wherein the CD8 antigen, the CD4 antigen, and the third antigen are not the same. In certain embodiments, a quadraspecific antibody provided herein that binds to a CD8 antigen, a second binding domain comprising a CD4 antibody provided herein that that binds to a CD4 antigen, a third binding domain that binds to a third antigen, and a fourth binding domain that binds to a fourth antigen, wherein the CD8 antigen, the CD4 antigen, the third antigen, and the fourth antigen are not the same. In certain embodiments of a multispecific CD4/CD8 antibody provided herein, the first binding domain that binds to CD8 specifically binds to the CD8. In other embodiments of a multispecific CD4/CD8 antibody provided herein, the second binding domain that binds to CD4 specifically binds to the CD4. In yet other embodiments of a multispecific CD4/CD8 antibody provided herein, the first binding domain that binds to CD8 specifically binds to the CD8, and the second binding domain that binds to CD4 specifically binds to the CD4.

In some embodiments, the multispecific CD4/CD8 antibody comprises heavy chain variable regions and light chain variable region. In some embodiments, the first binding domain comprises a heavy chain variable region and a light chain variable region. In some embodiments, the second binding domain comprises a heavy chain variable region and a light chain variable region. In some embodiments, the first binding domain comprises a heavy chain variable region and a light chain variable region, and the second binding domain comprises a heavy chain variable region and a light chain variable region. In a some embodiments, the CD8 antibody is not a single domain antibody or nanobody. In some embodiments, the third binding domain comprises a heavy chain variable region and a light chain variable region. In some embodiments, the fourth binding domain comprises a heavy chain variable region and a light chain variable region.

In certain embodiments, the CD4/CD8 multispecific antibodies or antigen binding fragments thereof bind to a first epitope located on CD8 and a second epitope of located on CD4. In some embodiments, provided herein is a multispecific CD4/CD8 antibody comprising: (a) a first binding domain that binds to a CD8 antigen, and (b) a second binding domain that binds to a CD4 antigen. In some embodiments, provided herein is a multispecific CD4/CD8 antibody comprising: (a) a first binding domain that specifically binds to a CD8 antigen, and (b) a second binding domain that specifically binds to a CD4 antigen. In some embodiments, provided herein is a multispecific CD4/CD8 antibody comprising: (a) a first binding domain that binds to a first epitope on a CD8 antigen, and (b) a second binding domain that binds to a second epitope on a CD4 antigen. In some embodiments, provided herein is a multispecific antibody comprising: (a) a first binding domain that specifically binds to a first epitope on a CD8 antigen, and (b) a second binding domain that specifically binds to a second epitope on a CD4 antigen.

In specific embodiments, the CD8 antigen is on the surface of a T cell. In specific embodiments, the CD4 antigen is on the surface of a T cell. The binding of the CD4/CD8 multispecific antibody to CD4 and CD8 present on the surface of T cells can, for example, result in the killing of the cell. In other embodiments, the binding of the CD4/CD8 multispecific antibody to CD4 and CD8 present on the surface of T cells can, for example, result in the activation of the T cell.

In some embodiments, a multispecific antibody provided herein is a diabody, a cross-body, or a multispecific antibody obtained via a controlled Fab arm exchange as those described herein.

In some embodiments, the multispecific antibodies include IgG-like molecules with complementary CH3 domains that promote heterodimerization; recombinant IgG-like dual targeting molecules, wherein the two sides of the molecule each contain the Fab fragment or part of the Fab fragment of at least two different antibodies; IgG fusion molecules, wherein full length IgG antibodies are fused to an extra Fab fragment or parts of Fab fragment; Fc fusion molecules, wherein single chain Fv molecules or stabilized diabodies are fused to heavy-chain constant-domains, Fc-regions or parts thereof; Fab fusion molecules, wherein different Fab-fragments are fused together; ScFv- and diabody-based and heavy chain antibodies (e.g., domain antibodies, nanobodies) wherein different single chain Fv molecules or different diabodies or different heavy-chain antibodies (e.g. domain antibodies, nanobodies) are fused to each other or to another protein or carrier molecule.

In some embodiments, IgG-like molecules with complementary CH3 domains molecules include the Triomab/Quadroma (Trion Pharma/Fresenius Biotech), the Knobs-into-Holes (Genentech), CrossMAbs (Roche) and the electrostatically-matched (Amgen), the LUZ-Y (Genentech), the Strand Exchange Engineered Domain body (SEEDbody) (EMD Serono), the Biclonic (Merus) and the DuoBody (Genmab A/S).

In some embodiments, recombinant IgG-like dual targeting molecules include Dual Targeting (DT)-Ig (GSK/Domantis), Two-in-one Antibody (Genentech), Cross-linked Mabs (Karmanos Cancer Center), mAb2 (F-Star) and CovX-body (CovX/Pfizer).

In some embodiments, IgG fusion molecules include Dual Variable Domain (DVD)-Ig (Abbott), IgG-like Bispecific (ImClone/Eli Lilly), Ts2Ab (MedImmune/AZ) and BsAb (Zymogenetics), HERCULES (Biogen Idec) and TvAb (Roche).

In some embodiments, Fc fusion molecules can include ScFv/Fc Fusions (Academic Institution), SCORPION (Emergent BioSolutions/Trubion, Zymogenetics/BMS), Dual Affinity Retargeting Technology (Fc-DART) (MacroGenics) and Dual (ScFv)$_2$-Fab (National Research Center for Antibody Medicine—China).

In some embodiments, Fab fusion bispecific antibodies include F(ab)$_2$ (Medarex/AMGEN), Dual-Action or Bis-Fab (Genentech), Dock-and-Lock (DNL) (ImmunoMedics), Bivalent Bispecific (Biotecnol) and Fab-Fv (UCB-Celltech). ScFv-, diabody-based, and domain antibodies, include but are not limited to, Bispecific T Cell Engager (BiTE) (Micromet), Tandem Diabody (Tandab) (Affimed), Dual Affinity Retargeting Technology (DART) (MacroGenics), Single-chain Diabody (Academic), TCR-like Antibodies (AIT, ReceptorLogics), Human Serum Albumin ScFv Fusion (Merrimack) and COMBODY (Epigen Biotech), dual targeting nanobodies (Ablynx), dual targeting heavy chain only domain antibodies.

Full length bispecific antibodies provided herein can be generated for example using Fab arm exchange (or half molecule exchange) between two mono specific bivalent antibodies by introducing substitutions at the heavy chain CH3 interface in each half molecule to favor heterodimer formation of two antibody half molecules having distinct specificity either in vitro in cell-free environment or using co-expression. The Fab arm exchange reaction is the result of a disulfide-bond isomerization reaction and dissociation-association of CH3 domains. The heavy-chain disulfide bonds in the hinge regions of the parent mono specific antibodies are reduced. The resulting free cysteines of one of the parent monospecific antibodies form an inter heavy-chain disulfide bond with cysteine residues of a second parent mono specific antibody molecule and simultaneously CH3 domains of the parent antibodies release and reform by dissociation-association. The CH3 domains of the Fab arms can be engineered to favor heterodimerization over homodimerization. The resulting product is a bispecific antibody having two Fab arms or half molecules which each binding a distinct epitope, e.g., an epitope on CD8 and an epitope on CD4. Other methods of making multispecific antibodies are known and contemplated.

"Homodimerization" as used herein refers to an interaction of two heavy chains having identical CH3 amino acid sequences. "Homodimer" as used herein refers to an antibody having two heavy chains with identical CH3 amino acid sequences.

"Heterodimerization" as used herein refers to an interaction of two heavy chains having non-identical CH3 amino acid sequences. "Heterodimer" as used herein refers to an antibody having two heavy chains with non-identical CH3 amino acid sequences.

The "knob-in-hole" strategy (see, e.g., PCT Publ. No. WO2006/028936) can be used to generate full length bispecific antibodies. Briefly, selected amino acids forming the interface of the CH3 domains in human IgG can be mutated at positions affecting CH3 domain interactions to promote heterodimer formation. An amino acid with a small side chain (hole) is introduced into a heavy chain of an antibody specifically binding a first antigen and an amino acid with a large side chain (knob) is introduced into a heavy chain of an antibody specifically binding a second antigen. After co-expression of the two antibodies, a heterodimer is formed as a result of the preferential interaction of the heavy chain with a "hole" with the heavy chain with a "knob." Exemplary CH3 substitution pairs forming a knob and a hole are (expressed as modified position in the first CH3 domain of the first heavy chain/modified position in the second CH3 domain of the second heavy chain): T366Y/F405A, T366W/F405W, F405W/Y407A, T394W/Y407T, T394S/Y407A, T366W/T394S, F405W/T394S and T366W/T366S_L368A_Y407V.

Other strategies such as promoting heavy chain heterodimerization using electrostatic interactions by substituting positively charged residues at one CH3 surface and negatively charged residues at a second CH3 surface can be used, as described in US Pat. Publ. No. US2010/0015133; US Pat. Publ. No. US2009/0182127; US Pat. Publ. No. US2010/028637; or US Pat. Publ. No. US2011/0123532. In other strategies, heterodimerization can be promoted by the following substitutions (expressed as modified position in the first CH3 domain of the first heavy chain/modified position in the second CH3 domain of the second heavy chain): L351Y_F405AY407V/T394W, T366I_K392M_T394W/F405A_Y407V, T366L_K392M_T394W/F405A_Y407V, L351Y_Y407A/T366A_K409F, L351Y_Y407A/T366V K409F Y407A/T366A_K409F, or T350V_L351Y_F405A Y407V/T350V_T366L_K392L_T394W as described in U.S. Pat. Publ. No. US2012/0149876 or U.S. Pat. Publ. No. US2013/0195849.

In addition to methods described above, bispecific antibodies provided herein can be generated in vitro in a cell-free environment by introducing asymmetrical mutations in the CH3 regions of two mono specific homodimeric antibodies and forming the bispecific heterodimeric antibody from two parent monospecific homodimeric antibodies in reducing conditions to allow disulfide bond isomerization according to methods described in PCT Pat. Publ. No. WO2011/131746. In the methods, the first monospecific bivalent antibody and the second monospecific bivalent antibody are engineered to have certain substitutions at the CH3 domain that promotes heterodimer stability; the antibodies are incubated together under reducing conditions sufficient to allow the cysteines in the hinge region to undergo disulfide bond isomerization; thereby generating the bispecific antibody by Fab arm exchange. The incubation conditions can optionally be restored to non-reducing conditions. Exemplary reducing agents that can be used are 2-mercaptoethylamine (2-MEA), dithiothreitol (DTT), dithioerythritol (DTE), glutathione, tris (2-carboxyethyl) phosphine (TCEP), L-cysteine and beta-mercaptoethanol, preferably a reducing agent selected from the group consisting of: 2-mercaptoethylamine, dithiothreitol and tris (2-carboxyethyl) phosphine. For example, incubation for at least 90 min at a temperature of at least 20° C. in the presence of at least 25 mM 2-MEA or in the presence of at least 0.5 mM dithiothreitol at a pH from 5-8, for example at pH of 7.0 or at pH of 7.4 can be used.

In some embodiments, the CD8 multispecific antibody comprises a single chain antibody. In some embodiments, the CD8 multispecific antibody comprises a single domain antibody. In certain embodiments, the CD8 multispecific antibody comprises a nanobody. In certain embodiments, the CD8 multispecific antibody comprises a VHH antibody. In certain embodiments, the CD8 multispecific antibody comprises a llama antibody. In some embodiments, the CD8 multispecific antibody does not comprise a single chain antibody. In some embodiments, the CD8 multispecific antibody does not comprise a single domain antibody. In certain embodiments, the CD8 multispecific antibody does not comprise a nanobody. In certain embodiments, the CD8 multispecific antibody does not comprise a VHH antibody. In certain embodiments, the CD8 multispecific antibody does not comprise a llama antibody.

According to another particular aspect, provided herein is a CD8 antibody or antigen-binding fragment thereof that induces antibody-dependent cell-mediated cytotoxicity (ADCC). The antibody or antigen-binding fragment thereof can, for example, induce ADCC in vitro.

In certain embodiments, the antibody or antigen-binding fragment thereof induces T cell dependent cytotoxicity of a second cell in vitro with an $EC_{50}$ of less than about 160 pM, when assessed in vitro at an effector to target cell ratio of 1:1.

In some embodiments, CD8 is present on the surface of a T cell. In some embodiments, the CD8 is present on the surface of a T cell, and the second target antigen is on the surface of a second cell. In some embodiments, the second cell is killed when the multispecific antibody binds to the CD8 on the surface of the T cell and the second target antigen on the surface of the second cell.

In some embodiments, the multispecific antibody induces T cell dependent cytotoxicity of the second cell in vitro with an $EC_{50}$ of less than about 500 pM. In some embodiments, the multispecific antibody induces T cell dependent cytotoxicity of the second cell in vitro with an $EC_{50}$ of less than about 300 pM. In some embodiments, the multispecific antibody induces γδ T cell dependent cytotoxicity of the second cell in vitro with an $EC_{50}$ of less than about 160 pM. In some embodiments, the $EC_{50}$ is assessed with a mixture of γδ T effector cells and target cells expressing the second target antigen. In some embodiments, the effector cell to target cell ratio is about 0.01 to 1 to about 5 to 1. In some embodiments, the effector cell to target cell ratio is about 0.1 to 1 to about 2 to 1. In some embodiments, the effector cell to target cell ratio is about 1:1.

In certain embodiments, the $EC_{50}$ is less than about 1000 pM, less than about 900 pM, less than about 800 pM, less than about 700 pM, less than about 600 pM, less than about 500 pM, less than about 400 pM, less than about 300 pM, less than about 200 pM, less than about 190 pM, less than about 180 pM, less than about 170 pM, less than about 160 pM, less than about 150 pM, less than about 140 pM, less than about 130 pM, less than about 120 pM, less than about 110 pM, less than about 100 pM, less than about 90 pM, less than about 80 pM, less than about 70 pM, less than about 60 pM, less than about 50 pM, less than about 40 pM, less than about 30 pM, less than about 20 pM, or less than about 10 pM.

In certain embodiments, the effector to target cell ratio can, for example, be 0.01:1, 0.02:1, 0.03:1, 0.04:1, 0.05:1, 0.06:1, 0.07:1, 0.08:1, 0.09:1, 1:1, 2:1, 3:1, 4:1, 5:1, 6:1, 7:1, 8:1, 9:1, or 10:1. In certain embodiments, the concentration of the multispecific antibody or antigen-binding fragment thereof is about 0.000005 ng/mL, about 0.00005 ng/mL, about 0.0005, about 0.005 ng/mL, about 0.01 ng/mL, about 0.02 ng/mL, about 0.03 ng/mL, about 0.04 ng/mL, about 0.05 ng/mL, about 0.06 ng/mL, about 0.07 ng/mL, about 0.08 ng/mL, about 0.09 ng/mL, about 0.1 ng/mL, about 0.5 ng/mL, about 1.0 ng/mL, about 10 ng/mL, about 20 ng/mL about, about 30 ng/mL about 40 ng/mL, about 50 ng/mL, about 60 ng/mL, about 70 ng/mL, about 80 ng/mL, about 90 ng/mL, about 100 ng/mL, or about 1000 ng/mL.

In another aspect, provided herein is an antibody that competes for binding to CD8 with any of the CD8 antibodies described herein. In another aspect, provided herein is an antibody that binds to the same epitope as any of the CD8 antibodies described herein. In another aspect, provided is a CD8 antibody that binds an epitope on CD8 that overlaps with the epitope on CD8 bound by a CD8 antibody described herein. In some embodiments, the CD8 antibody comprises a VH CDR1, VH CDR2, and VH CDR3 of a CD8 antibody provided herein. In some embodiments, the CD8 antibody comprises a VL CDR1, VL CDR2, and VL CDR3 of a CD8 antibody provided herein. In some embodiments, the CD8 antibody comprises a VH CDR1, VH CDR2, VH CDR3, a VL CDR1, VL CDR2, and VL CDR3 of a CD8 antibody provided herein. In some embodiments, the CD8 antibody comprises a VH of a CD8 antibody provided herein. In some embodiments, the CD8 antibody comprises a VL of a CD8 antibody provided herein. In some embodiments, the CD8 antibody comprises a VH and a VL of a CD8 antibody provided herein. In some embodiments, the CD8 antibody comprises a VH CDR1, VH CDR2, VH CDR3, a VL CDR1, VL CDR2, and VL CDR3 of a CD8 antibody provided herein. In some embodiments, the VH CDR1, VH CDR2, VH CDR3, VL CDR1, VL CDR2, and VL CDR3 amino acid sequences of the CD8 antibody are according to the Kabat numbering system. In some embodiments, the VH CDR1, VH CDR2, VH CDR3, VL CDR1, VL CDR2, and VL CDR3 amino acid sequences of the CD8 antibody are according to the Chothia numbering system. In some embodiments, the VH CDR1, VH CDR2, VH CDR3, VL CDR1, VL CDR2, and VL CDR3 amino acid sequences of the CD8 antibody are according to the AbM numbering system. In some embodiments, the VH CDR1, VH CDR2, VH CDR3, VL CDR1, VL CDR2, and VL CDR3 amino acid sequences of the CD8 antibody are according to the Contact numbering system. In some embodiments, the VH CDR1, VH CDR2, VH CDR3, VL CDR1, VL CDR2, and VL CDR3 amino acid sequences of the CD8 antibody are according to the IMGT numbering system. In certain embodiments, the CD8 antibody is a multispecific antibody. In some embodiments, the CD8 antibody is a bispecific antibody.

In another aspect, provided is an antibody that competes for binding to CD8 with a CD8 reference antibody. In another aspect, provided is a CD8 antibody that binds to the same CD8 epitope as a CD8 reference antibody. In another aspect, provided is a CD8 antibody that binds an epitope on CD8 that overlaps with the epitope on CD8 bound by a CD8 reference antibody. In some embodiments, the CD8 reference antibody comprises a VH CDR1, VH CDR2, and VH CDR3 of a CD8 reference antibody provided herein. In some embodiments, the CD8 reference antibody comprises a VL CDR1, VL CDR2, and VL CDR3 of a CD8 reference antibody provided herein. In some embodiments, the CD8 reference antibody comprises a VH CDR1, VH CDR2, VH CDR3, a VL CDR1, VL CDR2, and VL CDR3 of a CD8 reference antibody provided herein. In some embodiments, the CD8 reference antibody comprises a VH of a CD8 reference antibody provided herein. In some embodiments, the CD8 reference antibody comprises a VL of a CD8 reference antibody provided herein. In some embodiments, the CD8 reference antibody comprises a VH and a VL of a CD8 reference antibody provided herein. In some embodiments, the CD8 reference antibody comprises a VH CDR1, VH CDR2, VH CDR3, a VL CDR1, VL CDR2, and VL CDR3 of a CD8 reference antibody provided herein. In some embodiments, the VH CDR1, VH CDR2, VH CDR3, VL CDR1, VL CDR2, and VL CDR3 amino acid sequences of the CD8 reference antibody are according to the Kabat numbering system. In some embodiments, the VH CDR1, VH CDR2, VH CDR3, VL CDR1, VL CDR2, and VL CDR3 amino acid sequences of the CD8 reference antibody are according to the Chothia numbering system. In some embodiments, the VH CDR1, VH CDR2, VH CDR3, VL CDR1, VL CDR2, and VL CDR3 amino acid sequences of the CD8 reference antibody are according to the AbM numbering system. In some embodiments, the VH CDR1, VH CDR2, VH CDR3, VL CDR1, VL CDR2, and VL CDR3 amino acid sequences of the CD8 reference antibody are according to the Contact numbering system. In some embodiments, the VH CDR1, VH CDR2, VH CDR3, VL CDR1, VL CDR2, and VL CDR3 amino acid sequences of the CD8 reference antibody are according to the IMGT numbering system. In certain embodiments, the antibody is a multispecific antibody. In some embodiments, the antibody is a bispecific antibody. In certain embodiments, the CD8 reference antibody is a multispecific antibody. In some embodiments, the CD8 reference antibody is a bispecific antibody.

The disclosure also provides an isolated multispecific antibody, comprising: a first half molecule and a second half molecule, wherein the first half molecule comprises a first antigen binding domain and a second antigen binding domain and the second half molecule comprises a third antigen binding domain, wherein the first antigen binding domain specifically binds CD8, the second antigen binding domain specifically binds a second target, and the third antigen binding domain specifically binds a third target. In certain embodiments, the second target is a TCR complex. In some embodiments, the multispecific antibody activates or recruits CD8+ CTLs upon co-engagement of the TCR complex and CD8. In some embodiments, the multispecific antibody is unable to activate or recruit CD8+ CTLs in the absence of co-engagement of the TCR complex and CD8. In some embodiments, the multispecific antibody specifically binds CD8 and the TCR complex with an affinity that results in activation or recruitment of CD8+ CTL only upon co-engagement of the TCR complex and CD8.

In some embodiments, the CD4 multispecific antibody comprises a single chain antibody. In some embodiments, the CD4 multispecific antibody comprises a single domain antibody. In certain embodiments, the CD4 multispecific antibody comprises a nanobody. In certain embodiments, the CD4 multispecific antibody comprises a VHH antibody. In certain embodiments, the CD4 multispecific antibody comprises a llama antibody. In some embodiments, the CD4 multispecific antibody does not comprise a single chain antibody. In some embodiments, the CD4 multispecific antibody does not comprise a single domain antibody. In certain embodiments, the CD4 multispecific antibody does not comprise a nanobody. In certain embodiments, the CD4 multispecific antibody does not comprise a VHH antibody. In certain embodiments, the CD4 multispecific antibody does not comprise a llama antibody.

According to another particular aspect, provided herein is a CD4 antibody or antigen-binding fragment thereof that induces antibody-dependent cell-mediated cytotoxicity (ADCC). The antibody or antigen-binding fragment thereof can, for example, induce ADCC in vitro.

In certain embodiments, the antibody or antigen-binding fragment thereof induces T cell dependent cytotoxicity of a second cell in vitro with an $EC_{50}$ of less than about 160 pM, when assessed in vitro at an effector to target cell ratio of 1:1.

In some embodiments, CD4 is present on the surface of a T cell. In some embodiments, the CD4 is present on the surface of a T cell, and the second target antigen is on the surface of a second cell. In some embodiments, the second cell is killed when the multispecific antibody binds to the CD4 on the surface of the T cell and the second target antigen on the surface of the second cell. In some embodiments, the multispecific antibody induces T cell dependent cytotoxicity of the second cell in vitro with an $EC_{50}$ of less than about 500 pM. In some embodiments, the multispecific antibody induces T cell dependent cytotoxicity of the second cell in vitro with an $EC_{50}$ of less than about 300 pM. In some embodiments, the multispecific antibody induces γδ T cell dependent cytotoxicity of the second cell in vitro with an $EC_{50}$ of less than about 160 pM. In some embodiments, the $EC_{50}$ is assessed with a mixture of γδ T effector cells and target cells expressing the second target antigen. In some embodiments, the effector cell to target cell ratio is about 0.01 to 1 to about 5 to 1. In some embodiments, the effector cell to target cell ratio is about 0.1 to 1 to about 2 to 1. In some embodiments, the effector cell to target cell ratio is about 1:1.

In certain embodiments, the $EC_{50}$ is less than about 1000 pM, less than about 900 pM, less than about 800 pM, less than about 700 pM, less than about 600 pM, less than about 500 pM, less than about 400 pM, less than about 300 pM, less than about 200 pM, less than about 190 pM, less than about 180 pM, less than about 170 pM, less than about 160 pM, less than about 150 pM, less than about 140 pM, less than about 130 pM, less than about 120 pM, less than about 110 pM, less than about 100 pM, less than about 90 pM, less than about 80 pM, less than about 70 pM, less than about 60 pM, less than about 50 pM, less than about 40 pM, less than about 30 pM, less than about 20 pM, or less than about 10 pM.

In certain embodiments, the effector to target cell ratio can, for example, be 0.01:1, 0.02:1, 0.03:1, 0.04:1, 0.05:1, 0.06:1, 0.07:1, 0.08:1, 0.09:1, 1:1, 2:1, 3:1, 4:1, 5:1, 6:1, 7:1, 8:1, 9:1, or 10:1.

In certain embodiments, the concentration of the multispecific antibody or antigen-binding fragment thereof is about 0.000005 ng/mL, about 0.00005 ng/mL, about 0.0005, about 0.005 ng/mL, about 0.01 ng/mL, about 0.02 ng/mL, about 0.03 ng/mL, about 0.04 ng/mL, about 0.05 ng/mL, about 0.06 ng/mL, about 0.07 ng/mL, about 0.08 ng/mL, about 0.09 ng/mL, about 0.1 ng/mL, about 0.5 ng/mL, about 1.0 ng/mL, about 10 ng/mL, about 20 ng/mL about, about 30 ng/mL about 40 ng/mL, about 50 ng/mL, about 60 ng/mL, about 70 ng/mL, about 80 ng/mL, about 90 ng/mL, about 100 ng/mL, or about 1000 ng/mL.

In another aspect, provided herein is an antibody that competes for binding to CD4 with any of the CD4 antibodies described herein. In another aspect, provided herein is an antibody that binds to the same epitope as any of the CD4 antibodies described herein. In another aspect, provided is a CD4 antibody that binds an epitope on CD4 that overlaps with the epitope on CD4 bound by a CD4 antibody described herein. In some embodiments, the CD4 antibody comprises a VH CDR1, VH CDR2, and VH CDR3 of a CD4 antibody provided herein. In some embodiments, the CD4 antibody comprises a VL CDR1, VL CDR2, and VL CDR3 of a CD4 antibody provided herein. In some embodiments, the CD4 antibody comprises a VH CDR1, VH CDR2, VH CDR3, a VL CDR1, VL CDR2, and VL CDR3 of a CD4 antibody provided herein. In some embodiments, the CD4 antibody comprises a VH of a CD4 antibody provided herein. In some embodiments, the CD4 antibody comprises a VL of a CD4 antibody provided herein. In some embodiments, the CD4 antibody comprises a VH and a VL of a CD4 antibody provided herein. In some embodiments, the CD4 antibody comprises a VH CDR1, VH CDR2, VH CDR3, a VL CDR1, VL CDR2, and VL CDR3 of a CD4 antibody provided herein. In some embodiments, the VH CDR1, VH CDR2, VH CDR3, VL CDR1, VL CDR2, and VL CDR3 amino acid sequences of the CD4 antibody are according to the Kabat numbering system. In some embodiments, the VH CDR1, VH CDR2, VH CDR3, VL CDR1, VL CDR2, and VL CDR3 amino acid sequences of the CD4 antibody are according to the Chothia numbering system. In some embodiments, the VH CDR1, VH CDR2, VH CDR3, VL CDR1, VL CDR2, and VL CDR3 amino acid sequences of the CD4 antibody are according to the AbM numbering system. In some embodiments, the VH CDR1, VH CDR2, VH CDR3, VL CDR1, VL CDR2, and VL CDR3 amino acid sequences of the CD4 antibody are according to the Contact numbering system. In some embodiments, the VH CDR1, VH CDR2, VH CDR3, VL CDR1, VL CDR2, and VL CDR3 amino acid sequences of the CD4 antibody are according to the IMGT numbering system. In certain embodiments, the CD4 antibody is a multispecific antibody. In some embodiments, the CD4 antibody is a bispecific antibody.

In another aspect, provided is an antibody that competes for binding to CD4 with a CD4 reference antibody. In another aspect, provided is a CD4 antibody that binds to the same CD4 epitope as a CD4 reference antibody. In another aspect, provided is a CD4 antibody that binds an epitope on CD4 that overlaps with the epitope on CD4 bound by a CD4 reference antibody. In some embodiments, the CD4 reference antibody comprises a VH CDR1, VH CDR2, and VH CDR3 of a CD4 reference antibody provided herein. In some embodiments, the CD4 reference antibody comprises a VL CDR1, VL CDR2, and VL CDR3 of a CD4 reference antibody provided herein. In some embodiments, the CD4 reference antibody comprises a VH CDR1, VH CDR2, VH CDR3, a VL CDR1, VL CDR2, and VL CDR3 of a CD4 reference antibody provided herein. In some embodiments, the CD4 reference antibody comprises a VH of a CD4 reference antibody provided herein. In some embodiments, the CD4 reference antibody comprises a VL of a CD4 reference antibody provided herein. In some embodiments, the CD4 reference antibody comprises a VH and a VL of a CD4 reference antibody provided herein. In some embodiments, the CD4 reference antibody comprises a VH CDR1, VH CDR2, VH CDR3, a VL CDR1, VL CDR2, and VL CDR3 of a CD4 reference antibody provided herein. In some embodiments, the VH CDR1, VH CDR2, VH CDR3, VL CDR1, VL CDR2, and VL CDR3 amino acid sequences of the CD4 reference antibody are according to the Kabat numbering system. In some embodiments, the VH CDR1, VH CDR2, VH CDR3, VL CDR1, VL CDR2, and VL CDR3 amino acid sequences of the CD4 reference antibody are according to the Chothia numbering system. In some embodiments, the VH CDR1, VH CDR2, VH CDR3, VL CDR1, VL CDR2, and VL CDR3 amino acid sequences of the CD4 reference antibody are according to the AbM numbering system. In some embodiments, the VH CDR1, VH CDR2, VH CDR3, VL CDR1, VL CDR2, and VL CDR3 amino acid sequences of the CD4 reference antibody are according to the Contact numbering system. In some embodiments, the VH CDR1, VH CDR2, VH CDR3, VL CDR1, VL CDR2, and VL CDR3 amino acid sequences of the CD4 reference antibody are according to the IMGT numbering system. In certain embodiments, the antibody is a multispecific antibody. In some embodiments, the antibody is a bispecific antibody. In certain embodiments, the CD4 reference antibody is a multispecific antibody. In some embodiments, the CD4 reference antibody is a bispecific antibody.

The disclosure also provides an isolated multispecific antibody, comprising: a first half molecule and a second half molecule, wherein the first half molecule comprises a first antigen binding domain and a second antigen binding domain and the second half molecule comprises a third antigen binding domain, wherein the first antigen binding domain specifically binds CD4, the second antigen binding domain specifically binds a second target, and the third antigen binding domain specifically binds a third target. In certain embodiments, the second target is a TCR complex. In some embodiments, the multispecific antibody activates or recruits CD4+ T cells upon co-engagement of the TCR complex and CD4. In some embodiments, the multispecific antibody is unable to activate or recruit CD4+ T cells in the absence of co-engagement of the TCR complex and CD4. In some embodiments, the multispecific antibody specifically binds CD4 and the TCR complex with an affinity that results in activation or recruitment of CD4+ T cells only upon co-engagement of the TCR complex and CD4.

In some embodiments described herein, immune effector properties of the antibodies provided herein can be enhanced or silenced through Fc modifications by techniques known to those skilled in the art. For example, Fc effector functions such as C1q binding, complement dependent cytotoxicity (CDC), antibody-dependent cell-mediated cytotoxicity (ADCC), antibody-dependent cell-mediated phagocytosis (ADCP), down regulation of cell surface receptors (e.g., B cell receptor; BCR), etc. can be provided and/or controlled by modifying residues in the Fc responsible for these activities.

"Antibody-dependent cell-mediated cytotoxicity" or "ADCC" refers to a cell-mediated reaction in which non-specific cytotoxic cells that express Fc receptors (FcRs) (e.g. Natural Killer (NK) cells, neutrophils, and macrophages) recognize bound antibody on a target cell and subsequently cause lysis of the target cell.

The ability of antibodies to induce ADCC can be enhanced by engineering their oligosaccharide component. Human IgG1 or IgG3 are N-glycosylated at Asn297 with the majority of the glycans in the well-known biantennary G0, G0F, G1, G1F, G2 or G2F forms. Antibodies produced by non-engineered CHO cells typically have a glycan fucose content of about at least 85%. The removal of the core fucose from the biantennary complex-type oligosaccharides attached to the Fc regions enhances the ADCC of antibodies via improved FcγRIIIa binding without altering antigen binding or CDC activity. Such Abs can be achieved using different methods reported to lead to the successful expression of relatively high defucosylated antibodies bearing the biantennary complex-type of Fc oligosaccharides such as control of culture osmolality (Konno et al., Cytotechnology 64:249-65, 2012), application of a variant CHO line Lec13 as the host cell line (Shields et al., J Biol Chem 277:26733-26740, 2002), application of a variant CHO line EB66 as the host cell line (Olivier et al., MAbs; 2(4), 2010; Epub ahead of print; PMID:20562582), application of a rat hybridoma cell line YB2/0 as the host cell line (Shinkawa et al., J Biol Chem 278:3466-3473, 2003), introduction of small interfering RNA specifically against the α-1,6-fucosyltrasferase (FUT8) gene (Mori et al., Biotechnol Bioeng 88:901-908, 2004), or coexpression of β-1,4-N-acetylglucosaminyltransferase III and golgi α-mannosidase II or a potent alpha-mannosidase I inhibitor, kifunensine (Ferrara et al., J Biol Chem 281:5032-5036, 2006, Ferrara et al., Biotechnol Bioeng 93:851-861, 2006; Xhou et al., Biotechnol Bioeng 99:652-65, 2008).

In some embodiments described herein, ADCC elicited by the antibodies provided herein can also be enhanced by certain substitutions in the antibody Fc. Exemplary substitutions are for example substitutions at amino acid positions 256, 290, 298, 312, 356, 330, 333, 334, 360, 378 or 430 (residue numbering according to the EU index) as described in U.S. Pat. No. 6,737,056.

In some embodiments, a CD8 antibody provided herein is chimeric. In some embodiments, a CD8 antibody provided herein is human. In some embodiments, a CD8 antibody provided herein is humanized. In certain embodiments, a CD8 antibody provided herein is an isolated CD8 antibody. In some embodiments, a CD8 antigen binding fragment provided herein is chimeric. In some embodiments, a CD8 antigen binding fragment provided herein is human. In some embodiments, a CD8 antigen binding fragment provided herein is humanized. In certain embodiments, a CD8 antigen binding fragment provided herein is an isolated CD8 antigen binding fragment. In some embodiments, a CD8 antibody provided herein is an IgG antibody. In some embodiments, the IgG antibody is an IgG1 antibody. In some embodiments, the IgG antibody is an IgG2 antibody. In some embodiments, the IgG antibody is an IgG3 antibody. In some embodiments, the IgG antibody is an IgG4 antibody. In some embodiments, a CD8 antibody provided herein is multivalent. In some embodiments, the antibody is capable of binding at least three antigens. In some embodiments, the antibody is capable of binding at least five antigens.

In some embodiments, a CD8 multispecific antibody provided herein is chimeric. In some embodiments, a CD8 multispecific antibody provided herein is human. In some embodiments, a CD8 multispecific antibody provided herein is humanized. In certain embodiments, a CD8 multispecific antibody provided herein is an isolated CD8 multispecific antibody. In some embodiments, a CD8 multispecific antibody comprising a CD8 antigen binding fragment provided herein is chimeric. In some embodiments, a CD8 multispecific antibody comprising a CD8 antigen binding fragment provided herein is human. In some embodiments, a CD8 multispecific antibody comprising a CD8 antigen binding fragment provided herein is humanized. In certain embodiments, a CD8 multispecific antibody comprising a CD8 antigen binding fragment provided herein is an isolated CD8 multispecific antibody. In certain embodiments, the CD8 multispecific antibody is a multispecific CD4/CD8 antibody.

In some embodiments of the CD8 multispecific antibodies provided herein, the first binding domain is human. In some embodiments, the second binding domain is human. In some embodiments of the CD8 multispecific antibodies provided herein, both the first binding domain and the second binding domain are human. In some embodiments of the CD8 multispecific antibodies provided herein, the first binding domain is humanized. In some embodiments of the CD8 multispecific antibodies provided herein, the second binding domain is humanized. In some embodiments of the CD8 multispecific antibodies provided herein, both the first binding domain and the second binding domain are humanized. In some embodiments of the CD8 multispecific antibodies provided herein, both the first binding domain is human and the second binding domain is humanized. In some embodiments of the CD8 multispecific antibodies provided herein, both the first binding domain is humanized and the second binding domain is human. In certain embodiments, the CD8 multispecific antibody is a multispecific CD4/CD8 antibody.

In some embodiments, a CD8 multispecific antibody provided herein is multivalent. In some embodiments, the multispecific antibody is capable of binding at least three antigens. In some embodiments, the multispecific antibody is capable of binding at least five antigens. In certain embodiments, the multispecific antibody is a multispecific antibody. In some embodiments, a CD8 multispecific antibody provided herein is an IgG antibody. In some embodiments, the IgG antibody is an IgG1 antibody. In some embodiments, the IgG antibody is an IgG2 antibody. In some embodiments, the IgG antibody is an IgG3 antibody. In some embodiments, the IgG antibody is an IgG4 antibody. In certain embodiments, the CD8 multispecific antibody is a multispecific CD4/CD8 antibody.

In certain embodiments, CD8 antibodies provided herein are part of a multispecific antibody. In some embodiments, the multispecific antibody comprises a first binding domain that binds to a CD8 antigen. In some embodiments, the multispecific antibody comprises a first binding domain that binds to a CD8 antigen and comprises a second binding domain that binds to a second target antigen, as provided herein. In certain embodiments, the multispecific antibody binds to a CD8 antigen, a second target antigen, and one or more additional antigens. In some embodiments of the various antibodies provided herein, the antibody binds to an epitope of a given antigen. In certain embodiments, the multispecific CD8 antibody is a multispecific CD4/CD8 antibody, wherein the second target is CD4.

In some embodiments, a CD4 antibody provided herein is chimeric. In some embodiments, a CD4 antibody provided herein is human. In some embodiments, a CD4 antibody provided herein is humanized. In certain embodiments, a CD4 antibody provided herein is an isolated CD4 antibody. In some embodiments, a CD4 antigen binding fragment provided herein is chimeric. In some embodiments, a CD4 antigen binding fragment provided herein is human. In some embodiments, a CD4 antigen binding fragment provided herein is humanized. In certain embodiments, a CD4 antigen binding fragment provided herein is an isolated CD4 antigen binding fragment. In some embodiments, a CD4 antibody provided herein is an IgG antibody. In some embodiments, the IgG antibody is an IgG1 antibody. In some embodiments, the IgG antibody is an IgG2 antibody. In some embodiments, the IgG antibody is an IgG3 antibody. In some embodiments, the IgG antibody is an IgG4 antibody. In some embodiments, a CD4 antibody provided herein is multivalent. In some embodiments, the antibody is capable of binding at least three antigens. In some embodiments, the antibody is capable of binding at least five antigens.

In some embodiments, a CD4 multispecific antibody provided herein is chimeric. In some embodiments, a CD4 multispecific antibody provided herein is human. In some embodiments, a CD4 multispecific antibody provided herein is humanized. In certain embodiments, a CD4 multispecific antibody provided herein is an isolated CD4 multispecific antibody. In some embodiments, a CD4 multispecific antibody comprising a CD4 antigen binding fragment provided herein is chimeric. In some embodiments, a CD4 multispecific antibody comprising a CD4 antigen binding fragment provided herein is human. In some embodiments, a CD4 multispecific antibody comprising a CD4 antigen binding fragment provided herein is humanized. In certain embodiments, a CD4 multispecific antibody comprising a CD4 antigen binding fragment provided herein is an isolated CD4 multispecific antibody. In certain embodiments, the CD4 multispecific antibody is a multispecific CD4/CD8 antibody.

In some embodiments of the CD4 multispecific antibodies provided herein, the first binding domain is human. In some embodiments, the second binding domain is human. In some embodiments of the CD4 multispecific antibodies provided herein, both the first binding domain and the second binding domain are human. In some embodiments of the CD4 multispecific antibodies provided herein, the first binding domain is humanized. In some embodiments of the CD4 multispecific antibodies provided herein, the second binding domain is humanized. In some embodiments of the CD4 multispecific antibodies provided herein, both the first binding domain and the second binding domain are humanized. In some embodiments of the CD4 multispecific antibodies provided herein, both the first binding domain is human and the second binding domain is humanized. In some embodiments of the CD4 multispecific antibodies provided herein, both the first binding domain is humanized and the second binding domain is human. In certain embodiments, the CD4 multispecific antibody is a multispecific CD4/CD8 antibody.

In some embodiments, a CD4 multispecific antibody provided herein is multivalent. In some embodiments, the multispecific antibody is capable of binding at least three antigens. In some embodiments, the multispecific antibody is capable of binding at least five antigens. In certain embodiments, the multispecific antibody is a multispecific antibody. In some embodiments, a CD4 multispecific antibody provided herein is an IgG antibody. In some embodiments, the IgG antibody is an IgG1 antibody. In some embodiments, the IgG antibody is an IgG2 antibody. In some embodiments, the IgG antibody is an IgG3 antibody. In some embodiments, the IgG antibody is an IgG4 antibody. In certain embodiments, the CD4 multispecific antibody is a multispecific CD4/CD8 antibody.

In certain embodiments, CD4 antibodies provided herein are part of a multispecific antibody. In some embodiments, the multispecific antibody comprises a first binding domain that binds to a CD4 antigen. In some embodiments, the multispecific antibody comprises a first binding domain that binds to a CD4 antigen and comprises a second binding domain that binds to a second target antigen, as provided herein. In certain embodiments, the multispecific antibody binds to a CD4 antigen, a second target antigen, and one or more additional antigens. In some embodiments of the various antibodies provided herein, the antibody binds to an epitope of a given antigen. In certain embodiments, the multispecific CD8 antibody is a multispecific CD4/CD8 antibody, wherein the second target is CD8.

Also provided is a nucleic acid encoding an antibody provided herein. In another general aspect, provide is a vector comprising an isolated nucleic acid encoding an antibody provided herein. In another general aspect, provided is a vector comprising an isolated nucleic acid encoding an antibody provided herein. Also provided is a vector comprising a nucleic acid encoding an antibody provided herein. Also provided is a host cell comprising a vector comprising a nucleic acid encoding an antibody provided herein. Also provided is a kit comprising the vector comprising a nucleic acid encoding an antibody provided herein, and packaging for the same. In another general aspect, provided herein is an isolated nucleic acid encoding a monoclonal antibody or antigen-binding fragment thereof provided herein.

In certain embodiments, the antibody is a CD8 antibody. In some embodiments, the antibody is a CD4 antibody. In certain embodiments, the antibody is a multispecific CD8 antibody. In some embodiments, the antibody is a multispecific CD4 antibody. In some embodiments, the antibody is a multispecific CD4/CD8 antibody.

Also provided is a nucleic acid encoding a multispecific antibody that binds to a CD8 provided herein. In another general aspect, provide is a vector comprising an isolated nucleic acid encoding a CD8 multispecific antibody provided herein. In another general aspect, provided is a vector comprising an isolated nucleic acid encoding a CD8 multispecific antibody provided herein. Also provided is a vector comprising a nucleic acid encoding a multispecific antibody that binds to CD8 provided herein. Also provided is a host cell comprising a vector comprising a nucleic acid encoding a multispecific antibody that binds to CD8 provided herein. Also provided is a kit comprising the vector comprising a nucleic acid encoding a multispecific antibody that binds to CD8 provided herein, and packaging for the same. Also provided is an isolated nucleic acid encoding a monoclonal antibody provided herein. Also provided is an isolated nucleic acid encoding an antigen binding fragment provided herein. Also provided is a nucleic acid encoding a multispecific antibody comprising: (a) a first binding domain that binds to CD8, and (b) a second binding domain that binds to a second target that is not CD8, as provided herein.

Also provided is a nucleic acid encoding a multispecific antibody that binds to a CD4 provided herein. In another general aspect, provide is a vector comprising an isolated nucleic acid encoding a CD4 multispecific antibody provided herein. In another general aspect, provided is a vector comprising an isolated nucleic acid encoding a CD4 multispecific antibody provided herein. Also provided is a vector comprising a nucleic acid encoding a multispecific antibody that binds to CD4 provided herein. Also provided is a host cell comprising a vector comprising a nucleic acid encoding a multispecific antibody that binds to CD4 provided herein. Also provided is a kit comprising the vector comprising a nucleic acid encoding a multispecific antibody that binds to CD4 provided herein, and packaging for the same. Also provided is an isolated nucleic acid encoding a monoclonal antibody provided herein. Also provided is an isolated nucleic acid encoding an antigen binding fragment provided herein. Also provided is a nucleic acid encoding a multispecific antibody comprising: (a) a first binding domain that binds to CD4, and (b) a second binding domain that binds to a second target that is not CD4, as provided herein.

Also provided is a nucleic acid encoding a multispecific CD4/CD8 antibody provided herein. In another general aspect, provide is a vector comprising an isolated nucleic acid encoding a multispecific CD4/CD8 antibody provided herein. In another general aspect, provided is a vector comprising an isolated nucleic acid encoding a multispecific CD4/CD8 antibody provided herein. Also provided is a vector comprising a nucleic acid encoding a multispecific CD4/CD8 antibody provided herein. Also provided is a host cell comprising a vector comprising a nucleic acid encoding a multispecific CD4/CD8 antibody provided herein. Also provided is a kit comprising the vector comprising a nucleic acid encoding a multispecific CD4/CD8 antibody provided herein, and packaging for the same. Also provided is an isolated nucleic acid encoding a monoclonal antibody provided herein. Also provided is an isolated nucleic acid encoding an antigen binding fragment provided herein. Also provided is a nucleic acid encoding a multispecific antibody comprising: (a) a first binding domain that binds to CD8, and (b) a second binding domain that binds to a CD4, as provided herein. In certain embodiments, the multispecific CD4/CD8 antibody is a trispecific antibody. In certain embodiments, the multispecific CD4/CD8 antibody is a quadraspecific antibody.

It will be appreciated by those skilled in the art that the coding sequence of a protein can be changed (e.g., replaced, deleted, inserted, etc.) without changing the amino acid sequence of the protein. Accordingly, it will be understood by those skilled in the art that nucleic acid sequences encoding antibodies provided herein can be altered without changing the amino acid sequences of the proteins.

Any vector known to those skilled in the art in view of the present disclosure can be used, such as a plasmid, a cosmid, a phage vector or a viral vector. In some embodiments, the vector is a recombinant expression vector such as a plasmid. The vector can include any element to establish a conventional function of an expression vector, for example, a promoter, ribosome binding element, terminator, enhancer, selection marker, and origin of replication. The promoter can be a constitutive, inducible or repressible promoter. A number of expression vectors capable of delivering nucleic acids to a cell are known in the art and can be used herein for production of an antibody or antigen-binding fragment thereof in the cell. Conventional cloning techniques or artificial gene synthesis can be used to generate a recombinant expression vector according to certain embodiments. Such techniques are well known to those skilled in the art in view of the present disclosure.

Also provided is a host cell comprising an isolated nucleic acid encoding an antibody provided herein. Also provided is a host cell comprising an isolated nucleic acid encoding an antigen binding fragment provided herein. Any host cell known to those skilled in the art in view of the present disclosure can be used for recombinant expression of antibodies or antigen-binding fragments thereof provided herein. In some embodiments, the host cells are *E. coli* TG1 or BL21 cells (for expression of, e.g., an scFv or Fab antibody), CHO-DG44 or CHO-K1 cells or HEK293 cells (for expression of, e.g., a full-length IgG antibody). According to particular embodiments, the recombinant expression vector is transformed into host cells by conventional methods such as chemical transfection, heat shock, or electroporation, where it is stably integrated into the host cell genome such that the recombinant nucleic acid is effectively expressed.

Also provided are methods of producing an antibody disclosed herein. The methods comprise culturing a cell comprising a nucleic acid encoding the antibody under conditions to produce an antibody and recovering the antibody from the cell or cell culture (e.g., from the supernatant). Expressed antibodies can be harvested from the cells and purified according to conventional techniques known in the art and as described herein.

Also provided is a method of producing a multispecific antibody disclosed herein. The methods comprise culturing a cell comprising a nucleic acid encoding the multispecific antibody thereof under conditions to produce the multispecific antibody and recovering the multispecific antibody from the cell or cell culture (e.g., from the supernatant). Expressed multispecific antibodies thereof can be harvested from the cells and purified according to conventional techniques known in the art and as described herein.

Pharmaceutical Compositions

In another general aspect, provided is a pharmaceutical composition comprising a CD8 antibody provided herein and a pharmaceutically acceptable carrier. In another general aspect, provided is a pharmaceutical composition comprising a CD4 antibody provided herein and a pharmaceutically acceptable carrier. In certain embodiments, the antibody is isolated. Also provided is a method of producing the pharmaceutical composition, comprising combining the antibody with a pharmaceutically acceptable carrier to obtain the pharmaceutical composition.

In another general aspect, provided is a pharmaceutical composition comprising a CD8 multispecific antibody provided herein and a pharmaceutically acceptable carrier. In certain embodiments, the multispecific antibody is isolated. Also provided is a method of producing the pharmaceutical composition, comprising combining the multispecific antibody with a pharmaceutically acceptable carrier to obtain the pharmaceutical composition. In another aspect, provided herein is a pharmaceutical composition comprising a comprising: (a) a first binding domain that binds to CD8, and (b) a second binding domain that binds to a second target that is not CD8, and a pharmaceutically acceptable carrier. Any of the multispecific antibodies provided herein are contemplated in the pharmaceutical compositions. In certain embodiments, the second binding domain binds to CD4.

In another general aspect, provided is a pharmaceutical composition comprising a CD4 multispecific antibody provided herein and a pharmaceutically acceptable carrier. In certain embodiments, the multispecific antibody is isolated. Also provided is a method of producing the pharmaceutical composition, comprising combining the multispecific antibody with a pharmaceutically acceptable carrier to obtain the pharmaceutical composition. In another aspect, provided herein is a pharmaceutical composition comprising a comprising: (a) a first binding domain that binds to CD4, and (b) a second binding domain that binds to a second target that is not CD4, and a pharmaceutically acceptable carrier. Any of the multispecific antibodies provided herein are contemplated in the pharmaceutical compositions. In certain embodiments, the second binding domain binds to CD8.

In another general aspect, provided is a pharmaceutical composition comprising a multispecific CD4/CD8 antibody provided herein and a pharmaceutically acceptable carrier. In certain embodiments, the multispecific CD4/CD8 antibody is isolated. Also provided is a method of producing the pharmaceutical composition, comprising combining the multispecific antibody with a pharmaceutically acceptable carrier to obtain the pharmaceutical composition. In another aspect, provided herein is a pharmaceutical composition comprising a comprising: (a) a first binding domain that binds to CD8, and (b) a second binding domain that binds to CD4, and a pharmaceutically acceptable carrier. Any of the multispecific antibodies provided herein are contemplated in the pharmaceutical compositions.

The term "pharmaceutical composition" as used herein means a product comprising an antibody provided herein together with a pharmaceutically acceptable carrier. Antibodies of provided herein and compositions comprising them are also useful in the manufacture of a medicament for therapeutic applications.

As used herein, the term "carrier" refers to any excipient, diluent, filler, salt, buffer, stabilizer, solubilizer, oil, lipid, lipid containing vesicle, microsphere, liposomal encapsulation, or other material well known in the art for use in pharmaceutical formulations. It will be understood that the characteristics of the carrier, excipient or diluent will depend on the route of administration for a particular application. As used herein, the term "pharmaceutically acceptable carrier" refers to a non-toxic material that does not interfere with the effectiveness of a composition provided herein the biological activity of a composition provided herein. According to particular embodiments, in view of the present disclosure, any pharmaceutically acceptable carrier suitable for use in an antibody pharmaceutical composition can be used herein.

The formulation of pharmaceutically active ingredients with pharmaceutically acceptable carriers is known in the art, e.g., Remington: The Science and Practice of Pharmacy (e.g. 21st edition (2005), and any later editions). Non-limiting examples of additional ingredients include: buffers, diluents, solvents, tonicity regulating agents, preservatives, stabilizers, and chelating agents. One or more pharmaceutically acceptable carriers can be used in formulating the pharmaceutical compositions provided herein.

In one embodiment, the pharmaceutical composition is a liquid formulation. A preferred example of a liquid formulation is an aqueous formulation, i.e., a formulation comprising water. The liquid formulation can comprise a solution, a suspension, an emulsion, a microemulsion, a gel, and the like. An aqueous formulation typically comprises at least 50% w/w water, or at least 60%, 70%, 75%, 80%, 85%, 90%, or at least 95% w/w of water.

In one embodiment, the pharmaceutical composition can be formulated as an injectable which can be injected, for example, via an injection device (e.g., a syringe or an infusion pump). The injection can be delivered subcutaneously, intramuscularly, intraperitoneally, intravitreally, or intravenously, for example.

In another embodiment, the pharmaceutical composition is a solid formulation, e.g., a freeze-dried or spray-dried composition, which can be used as is, or whereto the physician or the patient adds solvents, and/or diluents prior to use. Solid dosage forms can include tablets, such as compressed tablets, and/or coated tablets, and capsules (e.g., hard or soft gelatin capsules). The pharmaceutical composition can also be in the form of sachets, dragees, powders, granules, lozenges, or powders for reconstitution, for example.

The dosage forms can be immediate release, in which case they can comprise a water-soluble or dispersible carrier, or they can be delayed release, sustained release, or modified release, in which case they can comprise water-insoluble polymers that regulate the rate of dissolution of the dosage form in the gastrointestinal tract or under the skin.

In other embodiments, the pharmaceutical composition can be delivered intranasally, intrabuccally, or sublingually.

The pH in an aqueous formulation can be between pH 3 and pH 10. In one embodiment, the pH of the formulation is from about 7.0 to about 9.5. In another embodiment, the pH of the formulation is from about 3.0 to about 7.0.

In another embodiment, the pharmaceutical composition comprises a buffer. Non-limiting examples of buffers include: arginine, aspartic acid, bicine, citrate, disodium hydrogen phosphate, fumaric acid, glycine, glycylglycine, histidine, lysine, maleic acid, malic acid, sodium acetate, sodium carbonate, sodium dihydrogen phosphate, sodium phosphate, succinate, tartaric acid, tricine, and tris(hydroxymethyl)-aminomethane, and mixtures thereof. The buffer can be present individually or in the aggregate, in a concentration from about 0.01 mg/ml to about 50 mg/ml, for example from about 0.1 mg/ml to about 20 mg/ml. Pharmaceutical compositions comprising each one of these specific buffers constitute alternative embodiments.

In another embodiment, the pharmaceutical composition comprises a preservative. Non-limiting examples of preservatives include: benzethonium chloride, benzoic acid, benzyl alcohol, bronopol, butyl 4-hydroxybenzoate, chlorobutanol, chlorocresol, chlorohexidine, chlorphenesin, o-cresol, m-cresol, p-cresol, ethyl 4-hydroxybenzoate, imidurea, methyl 4-hydroxybenzoate, phenol, 2-phenoxyethanol, 2-phenylethanol, propyl 4-hydroxybenzoate, sodium dehydroacetate, thiomerosal, and mixtures thereof. The preservative can be present individually or in the aggregate, in a concentration from about 0.01 mg/ml to about 50 mg/ml, for example from about 0.1 mg/ml to about 20 mg/ml. Pharmaceutical compositions comprising each one of these specific preservatives constitute alternative embodiments.

In another embodiment, the pharmaceutical composition comprises an isotonic agent. Non-limiting examples of isotonic agents include a salt (such as sodium chloride), an amino acid (such as glycine, histidine, arginine, lysine, isoleucine, aspartic acid, tryptophan, and threonine), an alditol (such as glycerol, 1,2-propanediol propyleneglycol), 1,3-propanediol, and 1,3-butanediol), polyethyleneglycol (e.g. PEG400), and mixtures thereof. Another example of an isotonic agent includes a sugar. Non-limiting examples of sugars can include mono-, di-, or polysaccharides, or water-soluble glucans, including for example fructose, glucose, mannose, sorbose, xylose, maltose, lactose, sucrose, trehalose, dextran, pullulan, dextrin, cyclodextrin, alpha and beta-HPCD, soluble starch, hydroxyethyl starch, and sodium carboxymethyl-cellulose. Another example of an isotonic agent is a sugar alcohol, wherein the term "sugar alcohol" is defined as a C(4-8) hydrocarbon having at least one —OH group. Non-limiting examples of sugar alcohols include mannitol, sorbitol, inositol, galactitol, dulcitol, xylitol, and arabitol. The isotonic agent can be present individually or in the aggregate, in a concentration from about 0.01 mg/ml to about 50 mg/ml, for example from about 0.1 mg/ml to about 20 mg/ml. Pharmaceutical compositions comprising each one of these specific isotonic agents constitute alternative embodiments.

In another embodiment, the pharmaceutical composition comprises a chelating agent. Non-limiting examples of chelating agents include citric acid, aspartic acid, salts of ethylenediaminetetraacetic acid (EDTA), and mixtures thereof. The chelating agent can be present individually or in the aggregate, in a concentration from about 0.01 mg/ml to about 50 mg/ml, for example from about 0.1 mg/ml to about 20 mg/ml. Pharmaceutical compositions comprising each one of these specific chelating agents constitute alternative embodiments.

In another embodiment, the pharmaceutical composition comprises a stabilizer. Non-limiting examples of stabilizers include one or more aggregation inhibitors, one or more oxidation inhibitors, one or more surfactants, and/or one or more protease inhibitors.

In another embodiment, the pharmaceutical composition comprises a stabilizer, wherein said stabilizer is carboxy-/hydroxycellulose and derivates thereof (such as HPC, HPC-SL, HPC-L and HPMC), cyclodextrins, 2-methylthioethanol, polyethylene glycol (such as PEG 3350), polyvinyl alcohol (PVA), polyvinyl pyrrolidone, salts (such as sodium chloride), sulphur-containing substances such as monothioglycerol), or thioglycolic acid. The stabilizer can be present individually or in the aggregate, in a concentration from about 0.01 mg/ml to about 50 mg/ml, for example from about 0.1 mg/ml to about 20 mg/ml. Pharmaceutical compositions comprising each one of these specific stabilizers constitute alternative embodiments.

In further embodiments, the pharmaceutical composition comprises one or more surfactants, preferably a surfactant, at least one surfactant, or two different surfactants. The term "surfactant" refers to any molecules or ions that are comprised of a water-soluble (hydrophilic) part, and a fat-soluble (lipophilic) part. The surfactant can, for example, be selected from the group consisting of anionic surfactants, cationic surfactants, nonionic surfactants, and/or zwitterionic surfactants. The surfactant can be present individually or in the aggregate, in a concentration from about 0.1 mg/ml to about 20 mg/ml. Pharmaceutical compositions comprising each one of these specific surfactants constitute alternative embodiments.

In a further embodiment, the pharmaceutical composition comprises one or more protease inhibitors, such as, e.g., EDTA, and/or benzamidine hydrochloric acid (HCl). The protease inhibitor can be present individually or in the aggregate, in a concentration from about 0.1 mg/ml to about 20 mg/ml. Pharmaceutical compositions comprising each one of these specific protease inhibitors constitute alternative embodiments.

In another general aspect, provided herein is a method of producing a pharmaceutical composition comprising an antibody or antigen-binding fragment thereof provided herein, comprising combining an antibody or antigen-binding fragment thereof with a pharmaceutically acceptable carrier to obtain the pharmaceutical composition.

Methods of Use

The functional activity of antibodies provided herein can be characterized by methods known in the art and as described herein. Methods for characterizing antibodies and antigen-binding fragments thereof include, but are not limited to, affinity and specificity assays including Biacore, ELISA, and OctetRed analysis; binding assays to detect the binding of antibodies to target cells by FACS; binding assays to detect the binding of antibodies to the target antigen on cells. According to particular embodiments, the methods for characterizing antibodies and antigen-binding fragments thereof include those described below. In certain embodiments, the antibody is a CD8 antibody. In certain embodiments, the antibody is a CD4 antibody. In certain embodiments, the antibody is a multispecific CD8 antibody. In certain embodiments, the antibody is a multispecific CD4 antibody. In certain embodiments, the antibody is a multispecific CD4/CD8 antibody.

Also provided is a method of activating a T cell expressing CD8, comprising contacting the T cell with a CD8 antibody provided herein. In some embodiments, the contacting results in an increase in CD69, CD25, and/or Granzyme B expression, as compared to a control T cell expressing CD8.

In another general aspect, provided is a method of inactivating a T cell expressing CD8, comprising contacting the T cell with an antibody that binds to a CD8 provided herein. In another general aspect, provided is a method of blocking activation of a T cell expressing CD8, comprising contacting the T cell with an antibody that binds to a CD8 provided herein. In another general aspect, provided is a method of modulating the activation of a T cell expressing CD8, comprising contacting the T cell with an antibody that binds to a CD8 provided herein.

Also provided herein is a method of activating a T cell expressing CD4, comprising contacting the T cell with a CD4 antibody, as provided herein. In some embodiments, the contacting results in an increase in CD69, CD25, and/or Granzyme B expression, as compared to a control T cell expressing CD4.

In another general aspect, provided is a method of inactivating a T cell expressing CD4, comprising contacting the T cell with an antibody that binds to a CD4 provided herein. In another general aspect, provided is a method of blocking activation of a T cell expressing CD4, comprising contacting the T cell with an antibody that binds to a CD4 provided herein. In another general aspect, provided is a method of modulating the activation of a T cell expressing CD4, comprising contacting the T cell with an antibody that binds to a CD4 provided herein.

Also provided herein is a method of treating a disease or disorder in a subject, comprising administering to the subject a CD8 antibody provided herein. Also provided herein is a method of treating a disease or disorder in a subject, comprising administering to the subject a CD8 antigen binding fragment provided herein. Also provided herein is a method of treating a disease or disorder in a subject, comprising administering to the subject a pharmaceutical composition comprising a CD8 antibody provided herein. Also provided herein is a method of treating a disease or disorder in a subject, comprising administering to the subject a pharmaceutical composition comprising a CD8 antigen binding fragment provided herein.

Also provided herein is a method of treating a disease or disorder in a subject, comprising administering to the subject a CD4 antibody provided herein. Also provided herein is a method of treating a disease or disorder in a subject, comprising administering to the subject a CD4 antigen binding fragment provided herein. Also provided herein is a method of treating a disease or disorder in a subject, comprising administering to the subject a pharmaceutical composition comprising a CD4 antibody provided herein. Also provided herein is a method of treating a disease or disorder in a subject, comprising administering to the subject a pharmaceutical composition comprising a CD4 antigen binding fragment provided herein.

Also provided herein is a method of activating a T cell expressing CD8, comprising contacting the T cell with the multispecific antibody, as provided herein. In some embodiments, the contacting results in an increase in CD69, CD25, and/or Granzyme B expression, as compared to a control T cell expressing CD8. In certain embodiments, the antibody is a multispecific CD4/CD8 antibody.

In another aspect, provided herein is a method of inactivating a T cell expressing CD8, comprising contacting the T cell with the multispecific antibody, as provided herein. In another aspect, provided herein is a method of blocking activation of a T cell expressing CD8, comprising contacting the T cell with the multispecific antibody, as provided herein. In another aspect, provided herein is a method of modulating the activation of a T cell expressing CD8, comprising contacting the T cell with the multispecific antibody, as provided herein. In certain embodiments, the antibody is a multispecific CD4/CD8 antibody.

Also provided herein is a method of activating a T cell expressing CD4, comprising contacting the T cell with the multispecific antibody, as provided herein. In some embodiments, the contacting results in an increase in CD69, CD25, and/or Granzyme B expression, as compared to a control T cell expressing CD4. In certain embodiments, the antibody is a multispecific CD4/CD8 antibody.

In another aspect, provided herein is a method of inactivating a T cell expressing CD4, comprising contacting the T cell with the multispecific antibody, as provided herein. In another aspect, provided herein is a method of blocking activation of a T cell expressing CD4, comprising contacting the T cell with the multispecific antibody, as provided herein. In another aspect, provided herein is a method of modulating the activation of a T cell expressing CD4, comprising contacting the T cell with the multispecific antibody, as provided herein. In certain embodiments, the antibody is a multispecific CD4/CD8 antibody.

In another aspect, provided herein is a method of directing a T cell expressing CD8 to a target cell, the method comprising contacting the T cell with a multispecific antibody provided herein. In some embodiments, the contacting directs the T cell to the target cell. Also provided is a method of targeting an antigen on the surface of a target cell, the method comprising exposing the target cell to a CD8 multispecific antibody or antigen binding fragment thereof provided herein. Also provided is a method of targeting an antigen on the surface of a target cell, the method comprising exposing the target cell to a pharmaceutical composition comprising a CD8 multispecific antibody or antigen binding fragment thereof provided herein. In certain embodiments, the antibody is a multispecific CD4/CD8 antibody.

In another general aspect, provided is a method of targeting an antigen on the surface of a target cell, the method comprising exposing the target cell to a CD8 multispecific antibody or antigen binding fragment thereof or a pharmaceutical composition provided herein. In certain embodiments, the antibody is a multispecific CD4/CD8 antibody.

Also provided is a method of directing CD8-expressing T cells to a second target. The methods can comprise contacting the CD8-expressing T cell with a CD8 multispecific antibody or antigen binding fragment thereof provided herein, wherein the CD8 multispecific antibody or antigen binding fragment thereof directs the CD8-expressing T cell to the second target. Also provided is a method of directing a T cell expressing CD8 to a second target, the method comprising contacting the T cell with a multispecific antibody provided herein, wherein the contacting directs the T cell to the second target. In certain embodiments, the antibody is a multispecific CD4/CD8 antibody.

Also provided is a method for inhibiting growth or proliferation of target cells. The methods can comprise contacting the CD8-expressing T cells with a CD8 multispecific antibody or antigen binding fragment thereof provided herein, wherein contacting the target cells with the CD8 multispecific antibody or antigen binding fragment thereof composition inhibits the growth or proliferation of the target cells. Also provided is a method of inhibiting growth or proliferation of target cells expressing a second target antigen on the cell surface, the method comprising contacting the target cells with a multispecific antibody provided herein, wherein contacting the target cells with the pharmaceutical composition inhibits growth or proliferation of the target cells. In some embodiments, the target cells are in the presence of a T cell expressing CD8 while in contact with the multispecific antibody. In certain embodiments, the antibody is a multispecific CD4/CD8 antibody.

In another aspect, provided herein is a method of directing a T cell expressing CD4 to a target cell, the method comprising contacting the T cell with a multispecific antibody provided herein. In some embodiments, the contacting directs the T cell to the target cell. Also provided is a method of targeting an antigen on the surface of a target cell, the method comprising exposing the target cell to a CD4 multispecific antibody or antigen binding fragment thereof provided herein. Also provided is a method of targeting an antigen on the surface of a target cell, the method comprising exposing the target cell to a pharmaceutical composition comprising a CD4 multispecific antibody or antigen binding fragment thereof provided herein. In certain embodiments, the antibody is a multispecific CD4/CD8 antibody.

In another general aspect, provided is a method of targeting an antigen on the surface of a target cell, the method comprising exposing the target cell to a CD4 multispecific antibody or antigen binding fragment thereof or a pharmaceutical composition provided herein. In certain embodiments, the antibody is a multispecific CD4/CD8 antibody.

Also provided is a method of directing CD4-expressing T cells to a second target. The methods can comprise contacting the CD4-expressing T cell with a CD4 multispecific antibody or antigen binding fragment thereof provided herein, wherein the CD4 multispecific antibody or antigen binding fragment thereof directs the CD4-expressing T cell to the second target. Also provided is a method of directing a T cell expressing CD4 to a second target, the method comprising contacting the T cell with a multispecific antibody provided herein, wherein the contacting directs the T cell to the second target. In certain embodiments, the antibody is a multispecific CD4/CD8 antibody.

Also provided is a method for inhibiting growth or proliferation of target cells. The methods can comprise contacting the CD4-expressing T cells with a CD4 multispecific antibody or antigen binding fragment thereof provided herein, wherein contacting the target cells with the CD4 multispecific antibody or antigen binding fragment thereof composition inhibits the growth or proliferation of the target cells. Also provided is a method of inhibiting growth or proliferation of target cells expressing a second target antigen on the cell surface, the method comprising contacting the target cells with a multispecific antibody provided herein, wherein contacting the target cells with the pharmaceutical composition inhibits growth or proliferation of the target cells. In some embodiments, the target cells are in the presence of a T cell expressing CD4 while in contact with the multispecific antibody. In certain embodiments, the antibody is a multispecific CD4/CD8 antibody.

Also provided herein is a method of treating a disease or disorder in a subject, comprising administering to the subject a CD8 multispecific antibody provided herein. Also provided herein is a method of treating a disease or disorder in a subject, comprising administering to the subject a multispecific antibody comprising a CD8 antigen binding fragment provided herein. Also provided herein is a method of treating a disease or disorder in a subject, comprising administering to the subject a pharmaceutical composition comprising a CD8 multispecific antibody provided herein. Also provided herein is a method of treating a disease or disorder in a subject, comprising administering to the subject a pharmaceutical composition comprising a multispecific antibody comprising a CD8 antigen binding fragment provided herein. In certain embodiments, the antibody is a multispecific CD4/CD8 antibody.

In another general aspect, provided herein is a method of treating a disease or disorder in a subject, comprising administering to the subject an isolated multispecific antibody or antigen binding fragment thereof that specifically binds CD8 and a second target antigen presented on the surface of a target cell, or a pharmaceutical composition disclosed herein. In some embodiments, provided is a method for eliminating target cells expressing the second antigen or treating a disease caused all or in part by target cells expressing the second antigen in a subject, comprising administering an effective amount of a multispecific antibody provided herein to the subject. In certain embodiments, the antibody is a multispecific CD4/CD8 antibody.

Also provided herein is a method of treating a disease or disorder in a subject, comprising administering to the subject a CD4 multispecific antibody provided herein. Also provided herein is a method of treating a disease or disorder in a subject, comprising administering to the subject a multispecific antibody comprising a CD4 antigen binding fragment provided herein. Also provided herein is a method of treating a disease or disorder in a subject, comprising administering to the subject a pharmaceutical composition comprising a CD4 multispecific antibody provided herein. Also provided herein is a method of treating a disease or disorder in a subject, comprising administering to the subject a pharmaceutical composition comprising a multispecific antibody comprising a CD4 antigen binding fragment provided herein. In certain embodiments, the antibody is a multispecific CD4/CD8 antibody.

In another general aspect, provided herein is a method of treating a disease or disorder in a subject, comprising administering to the subject an isolated multispecific antibody or antigen binding fragment thereof that specifically binds CD4 and a second target antigen presented on the surface of a target cell, or a pharmaceutical composition disclosed herein. In some embodiments, provided is a method for eliminating target cells expressing the second antigen or treating a disease caused all or in part by target cells expressing the second antigen in a subject, comprising administering an effective amount of a multispecific antibody provided herein to the subject. In certain embodiments, the antibody is a multispecific CD4/CD8 antibody.

In some embodiments, the subject is a subject in need thereof. In some embodiments, the subject is a human. In specific embodiments, the subject is administered an effective amount.

As used herein, the term "effective amount" refers to an amount of an active ingredient or component that elicits the desired biological or medicinal response in a subject.

According to particular embodiments, an effective amount refers to the amount of therapy which is sufficient to achieve one, two, three, four, or more of the following effects: (i) reduce or ameliorate the severity of the disease, disorder or condition to be treated or a symptom associated therewith; (ii) reduce the duration of the disease, disorder or condition to be treated, or a symptom associated therewith; (iii) prevent the progression of the disease, disorder or condition to be treated, or a symptom associated therewith; (iv) cause regression of the disease, disorder or condition to be treated, or a symptom associated therewith; (v) prevent the development or onset of the disease, disorder or condition to be treated, or a symptom associated therewith; (vi) prevent the recurrence of the disease, disorder or condition to be treated, or a symptom associated therewith; (vii) reduce hospitalization of a subject having the disease, disorder or condition to be treated, or a symptom associated therewith; (viii) reduce hospitalization length of a subject having the disease, disorder or condition to be treated, or a symptom associated therewith; (ix) increase the survival of a subject with the disease, disorder or condition to be treated, or a symptom associated therewith; (xi) inhibit or reduce the disease, disorder or condition to be treated, or a symptom associated therewith in a subject; and/or (xii) enhance or improve the prophylactic or therapeutic effect(s) of another therapy.

The effective amount or dosage can vary according to various factors, such as the disease, disorder or condition to be treated, the means of administration, the target site, the physiological state of the subject (including, e.g., age, body weight, health), whether the subject is a human or an animal, other medications administered, and whether the treatment is prophylactic or therapeutic. Treatment dosages are optimally titrated to optimize safety and efficacy.

According to particular embodiments, the compositions described herein are formulated to be suitable for the intended route of administration to a subject. For example, the compositions described herein can be formulated to be suitable for intravenous, subcutaneous, or intramuscular administration.

As used herein, the terms "treat," "treating," and "treatment" are all intended to refer to an amelioration or reversal of at least one measurable physical parameter related to a cancer, which is not necessarily discernible in the subject, but can be discernible in the subject. The terms "treat," "treating," and "treatment," can also refer to causing regression, preventing the progression, or at least slowing down the progression of the disease, disorder, or condition. In a particular embodiment, "treat," "treating," and "treatment" refer to an alleviation, prevention of the development or onset, or reduction in the duration of one or more symptoms associated with the disease, disorder, or condition, such as a tumor or more preferably a cancer. In a particular embodiment, "treat," "treating," and "treatment" refer to prevention of the recurrence of the disease, disorder, or condition. In a particular embodiment, "treat," "treating," and "treatment" refer to an increase in the survival of a subject having the disease, disorder, or condition. In a particular embodiment, "treat," "treating," and "treatment" refer to elimination of the disease, disorder, or condition in the subject.

In some embodiments, a CD8 antibody provided herein is used in combination with a supplemental therapy. In some embodiments, a CD4 antibody provided herein is used in combination with a supplemental therapy.

As used herein, the term "in combination," in the context of the administration of two or more therapies to a subject, refers to the use of more than one therapy. The use of the term "in combination" does not restrict the order in which therapies are administered to a subject. For example, a first therapy (e.g., a composition described herein) can be administered prior to (e.g., 5 minutes, 15 minutes, 30 minutes, 45 minutes, 1 hour, 2 hours, 4 hours, 6 hours, 12 hours, 16 hours, 24 hours, 48 hours, 72 hours, 96 hours, 1 week, 2 weeks, 3 weeks, 4 weeks, 5 weeks, 6 weeks, 8 weeks, or 12 weeks before), concomitantly with, or subsequent to (e.g., 5 minutes, 15 minutes, 30 minutes, 45 minutes, 1 hour, 2 hours, 4 hours, 6 hours, 12 hours, 16 hours, 24 hours, 48 hours, 72 hours, 96 hours, 1 week, 2 weeks, 3 weeks, 4 weeks, 5 weeks, 6 weeks, 8 weeks, or 12 weeks after) the administration of a second therapy to a subject.

Enrichment and Detection Methods

In one aspect, the CD8 antibodies provided herein are used as agents to detect CD8-expressing cells. Thus, in other methods, provided is a method of detecting a cell expressing CD8, comprising contacting a cell with a CD8 antibody provided herein. In certain embodiments, the detecting is by ELISA. In some embodiments, the detecting is by FACS analysis. Also provided are kits comprising a CD8 antibody provided herein, and instructions for use.

Enrichment, isolation, separation, purification, sorting, selecting, capturing or detecting, or any combination thereof can be done using known technologies such as bead, microfluidics, solid support, columns, and the like. For example, CD8+ CTL may be separated or visualized using known methods when bound to the CD8 antibodies provided herein.

The CD8 antibodies or multispecific CD8 antibodies provided herein can be used to selectively enrich, isolate, separate, purify, sort, select, capture or detect CD8-expressing cells. The CD8 antibodies or multispecific CD8 antibodies provided herein may be utilized in a bispecific format, e.g. containing a first antigen binding domain that specifically binds CD8 and a second antigen binding domain that specifically binds a second target. In other embodiments, the multispecific CD8 antibodies provided herein may be utilized in a format that further incorporates a third antigen binding domain that specifically binds a third antigen (e.g., at a trispecific antibody). In other embodiments, the multispecific CD8 antibodies provided herein may be utilized in a format that further incorporates a fourth antigen binding domain that specifically binds a fourth antigen. (e.g., as a quadraspecific antibody).

In one aspect, provided herein is a method of enriching a CD8-expressing cell comprising: providing a sample comprising the CD8-expressing cell; contacting the sample with a CD8 antibody provided herein; and enriching the CD8-expressing cell bound to the CD8 antibody. In one aspect, provided herein is a method of isolating a CD8-expressing cell comprising: providing a sample comprising the CD8-expressing cell; contacting the sample with a CD8 antibody provided herein; and isolating the CD8-expressing cell bound to the CD8 antibody. In one aspect, provided herein is a method of separating a CD8-expressing cell comprising: providing a sample comprising the CD8-expressing cell; contacting the sample with a CD8 antibody provided herein; and separating the CD8-expressing cell bound to the CD8 antibody. In one aspect, provided herein is a method of purifying a CD8-expressing cell comprising: providing a sample comprising the CD8-expressing cell; contacting the sample with a CD8 antibody provided herein; and purifying the CD8-expressing cell bound to the CD8 antibody. In one aspect, provided herein is a method of sorting a CD8-expressing cell comprising: providing a sample comprising the CD8-expressing cell; contacting the sample with a CD8 antibody provided herein; and sorting the CD8-expressing cell bound to the CD8 antibody. In one aspect, provided herein is a method of selecting a CD8-expressing cell comprising: providing a sample comprising the CD8-expressing cell; contacting the sample with a CD8 antibody provided herein; and selecting the CD8-expressing cell bound to the CD8 antibody. In one aspect, provided herein is a method of capturing a CD8-expressing cell comprising: providing a sample comprising the CD8-expressing cell; contacting the sample with a CD8 antibody provided herein; and capturing the CD8-expressing cell bound to the CD8 antibody. In one aspect, provided herein is a method of detecting a CD8-expressing cell comprising: providing a sample comprising the CD8-expressing cell; contacting the sample with a CD8 antibody provided herein; and detecting the CD8-expressing cell bound to the CD8 antibody.

In one aspect, provided herein is a method of enriching a CD8-expressing cell comprising: contacting a CD8-expressing cell with a CD8 antibody provided herein; and enriching the CD8-expressing cell bound to the CD8 antibody. In one aspect, provided herein is a method of isolating a CD8-expressing cell comprising: contacting a CD8-expressing cell with a CD8 antibody provided herein; and isolating the CD8-expressing cell bound to the CD8 antibody. In one aspect, provided herein is a method of separating a CD8-expressing cell comprising: contacting a CD8-expressing cell with a CD8 antibody provided herein; and separating the CD8-expressing cell bound to the CD8 antibody. In one aspect, provided herein is a method of purifying a CD8- expressing cell comprising: contacting a CD8-expressing cell with a CD8 antibody provided herein; and purifying the CD8-expressing cell bound to the CD8 antibody. In one aspect, provided herein is a method of sorting a CD8-expressing cell comprising: contacting a CD8-expressing cell with a CD8 antibody provided herein; and sorting the CD8-expressing cell bound to the CD8 antibody. In one aspect, provided herein is a method of selecting a CD8-expressing cell comprising: contacting a CD8-expressing cell with a CD8 antibody provided herein; and selecting the CD8-expressing cell bound to the CD8 antibody. In one aspect, provided herein is a method of capturing a CD8-expressing cell comprising: contacting a CD8-expressing cell with a CD8 antibody provided herein; and capturing the CD8-expressing cell bound to the CD8 antibody. In one aspect, provided herein is a method of detecting a CD8-expressing cell comprising: contacting a CD8-expressing cell with a CD8 antibody provided herein; and detecting the CD8-expressing cell bound to the CD8 antibody.

In one aspect, provided herein is a method of enriching a CD8-expressing cell comprising: contacting a CD8-expressing cell with a CD8 antibody provided herein; and enriching the CD8-expressing cell based on binding of the CD8-expressing cell to the CD8 antibody. In one aspect, provided herein is a method of isolating a CD8-expressing cell comprising: contacting a CD8-expressing cell with a CD8 antibody provided herein; and isolating the CD8-expressing cell based on binding of the CD8-expressing cell to the CD8 antibody. In one aspect, provided herein is a method of separating a CD8-expressing cell comprising: contacting a CD8-expressing cell with a CD8 antibody provided herein; and separating the CD8-expressing cell based on binding of the CD8-expressing cell to the CD8 antibody. In one aspect, provided herein is a method of purifying a CD8-expressing cell comprising: contacting a CD8-expressing cell with a CD8 antibody provided herein; and purifying the CD8-expressing cell based on binding of the CD8-expressing cell to the CD8 antibody. In one aspect, provided herein is a method of sorting a CD8-expressing cell comprising: contacting a CD8-expressing cell with a CD8 antibody provided herein; and sorting the CD8-expressing cell based on binding of the CD8-expressing cell to the CD8 antibody. In one aspect, provided herein is a method of selecting a CD8-expressing cell comprising: contacting a CD8-expressing cell with a CD8 antibody provided herein; and selecting the CD8-expressing cell based on binding of the CD8-expressing cell to the CD8 antibody. In one aspect, provided herein is a method of capturing a CD8-expressing cell comprising: contacting a CD8-expressing cell with a CD8 antibody provided herein; and capturing the CD8-expressing cell based on binding of the CD8-expressing cell to the CD8 antibody. In one aspect, provided herein is a method of detecting a CD8-expressing cell comprising: contacting a CD8-expressing cell with a CD8 antibody provided herein; and detecting the CD8-expressing cell based on binding of the CD8-expressing cell to the CD8 antibody.

In certain embodiments of the methods, the CD8-expressing cell is a T cell. In certain embodiments of the methods, the CD8-expressing cell is a CD8+ cytotoxic T lymphocyte (CTL). In some embodiments of the methods, the CD8-expressing cell is in a population of cells. In some embodiments of the methods, the CD8-expressing cell is in a population of lymphocytes. In some embodiments of the methods, the CD8-expressing cell is in a population of T cells. In some embodiments of the methods, the CD8-expressing cell is provided as a population of cells. In some embodiments of the methods, the CD8-expressing cell is provided as a population of lymphocytes. In some embodiments of the methods, the CD8-expressing cell is provided as a population of T cells. In some embodiments of the methods, the CD8-expressing cell is provided as a sample comprising a population of cells. In some embodiments of the methods, the CD8-expressing cell is provided as a sample comprising a population of lymphocytes. In some embodiments of the methods, the CD8-expressing cell is provided as a sample comprising a population of T cells. In some embodiments of the methods, the sample is a blood sample. In some embodiments of the methods, the sample is a tissue sample. In some embodiments of the methods, the sample is a tissue culture sample.

In some embodiments of the methods, the CD8 antibody is a multispecific CD8 antibody provided herein. In some embodiments of the methods, the CD8 antibody is a bispecific CD8 antibody provided herein. In some embodiments of the methods, the CD8 antibody is a trispecific CD8 antibody provided herein. In some embodiments of the methods, the CD8 antibody is a quadraspecific CD8 antibody provided herein. In certain embodiments, the CD8 antibody specifically binds to CD8. In one embodiment, the multispecific CD8 antibody comprises: (a) a first binding domain that binds CD8, and (b) a second binding domain that binds to a second target. In one embodiment, the multispecific CD8 antibody comprises: (a) a first binding domain that binds CD8, and (b) a second binding domain that binds to a second target, and (c) a third binding domain that binds to a third target. In one embodiment, the multispecific CD8 antibody comprises: (a) a first binding domain that binds CD8, and (b) a second binding domain that binds to a second target, (c) a third binding domain that binds to a third target, and (d) a fourth binding domain that binds to a fourth target. In one embodiment, the multispecific CD8 antibody comprises: (a) a first binding domain that specifically binds CD8, and (b) a second binding domain that specifically binds to a second target. In one embodiment, the multispecific CD8 antibody comprises: (a) a first binding domain that specifically binds CD8, and (b) a second binding domain that specifically binds to a second target, and (c) a third binding domain that specifically binds to a third target. In one embodiment, the multispecific CD8 antibody comprises: (a) a first binding domain that specifically binds CD8, and (b) a second binding domain that specifically binds to a second target, (c) a third binding domain that specifically binds to a third target, and (d) a fourth binding domain that specifically binds to a fourth target.

In some embodiments of the methods, the CD8 antibody is a multispecific CD8 antibody, wherein the second target is CD4. In some embodiments, the second target is a TCR complex. In some embodiments of the methods, the CD8 antibody is a multispecific CD8 antibody, wherein the second target is CD3. In some embodiments, CD3 comprises CD3ε. In some embodiments, CD3 comprises CD3γ. In some embodiments, CD3 comprises CD3δ. In some embodiments, CD3 comprises CD3ζ. In some embodiments of the methods, the CD8 antibody is a multispecific CD8 antibody, wherein the second target is CD3ε. In some embodiments of the methods, the CD8 antibody is a multispecific CD8 antibody, wherein the second target is CD3γ. In some embodiments of the methods, the CD8 antibody is a multispecific CD8 antibody, wherein the second target is CD3δ. In some embodiments of the methods, the CD8 antibody is a multispecific CD8 antibody, wherein the second target is CD3ζ. In some embodiments of the methods, the CD8 antibody is a multispecific CD8 antibody, wherein the second target is a TCRα chain. In some embodiments of the methods, the CD8 antibody is a multispecific CD8 antibody, wherein the second target is a TCRβ chain. In some embodiments of the methods, the CD8 antibody is a multispecific CD8 antibody, wherein the second target is a TCRγ chain. In some embodiments of the methods, the CD8 antibody is a multispecific CD8 antibody, wherein the second target is a TCRδ chain. In some embodiments of the methods, the CD8 antibody is a multispecific CD8 antibody, wherein the second target is a T cell costimulatory molecule. In some embodiments of the methods, the CD8 antibody is a multispecific CD8 antibody, wherein the second target is CD28. In some embodiments of the methods, the CD8 antibody is a multispecific CD8 antibody, wherein the second target is CTLA4. In some embodiments of the methods, the CD8 antibody is a multispecific CD8 antibody, wherein the second target is ICOS. In some embodiments of the methods, the CD8 antibody is a multispecific CD8 antibody, wherein the second target is 4-1BB. In some embodiments of the methods, the CD8 antibody is a multispecific CD8 antibody, wherein the second target is GITR. In some embodiments of the methods, the CD8 antibody is a multispecific CD8 antibody, wherein the second target is CD27. In some embodiments of the methods, the CD8 antibody is a multispecific CD8 antibody, wherein the second target is OX40. In some embodiments of the methods, the CD8 antibody is a multispecific CD8 antibody, wherein the second target is CD40L. In some embodiments of the methods, the CD8 antibody is a multispecific CD8 antibody, wherein the second target is HVEM. In some embodiments of the methods, the CD8 antibody is a multispecific CD8 antibody, wherein the second target is Galectin-9. In some embodiments of the methods, the CD8 antibody is a multispecific CD8 antibody, wherein the second target is TIM-1 In some embodiments of the methods, the CD8 antibody is a multispecific CD8 antibody, wherein the second target is LFA1 In some embodiments of the methods, the CD8 antibody is a multispecific CD8 antibody, wherein the second target is CD2. In some embodiments of the methods, the CD8 antibody is a multispecific CD8 antibody, wherein the second target is PD1. In some embodiments of the methods, the CD8 antibody is a multispecific CD8 antibody, wherein the third target is a TCR complex. In some embodiments of the methods, the CD8 antibody is a multispecific CD8 antibody, wherein the third target is CD3. In some embodiments of the methods, the CD8 antibody is a multispecific CD8 antibody, wherein the third target is CD3ε. In some embodiments of the methods, the CD8 antibody is a multispecific CD8 antibody, wherein the third target is CD3γ. In some embodiments of the methods, the CD8 antibody is a multispecific CD8 antibody, wherein the third target is CD3δ. In some embodiments of the methods, the CD8 antibody is a multispecific CD8 antibody, wherein the third target is CD3ζ. In some embodiments of the methods, the CD8 antibody is a multispecific CD8 antibody, wherein the third target is a TCRα chain. In some embodiments of the methods, the CD8 antibody is a multispecific CD8 antibody, wherein the third target is a TCRβ chain. In some embodiments of the methods, the CD8 antibody is a multispecific CD8 antibody, wherein the third target is a TCRγ chain. In some embodiments of the methods, the CD8 antibody is a multispecific CD8 antibody, wherein the third target is a TCRδ chain. In some embodiments of the methods, the CD8 antibody is a multispecific CD8 antibody, wherein the third target is a T cell costimulatory molecule. In some embodiments of the methods, the CD8 antibody is a multispecific CD8 antibody, wherein the third target is CD28. In some embodiments of the methods, the CD8 antibody is a multispecific CD8 antibody, wherein the third target is CTLA4. In some embodiments of the methods, the CD8 antibody is a multispecific CD8 antibody, wherein the third target is ICOS. In some embodiments of the methods, the CD8 antibody is a multispecific CD8 antibody, wherein the third target is 4-1BB. In some embodiments of the methods, the CD8 antibody is a multispecific CD8 antibody, wherein the third target is GITR. In some embodiments of the methods, the CD8 antibody is a multispecific CD8 antibody, wherein the third target is CD27. In some embodiments of the methods, the CD8 antibody is a multispecific CD8 antibody, wherein the third target is OX40. In some embodiments of the methods, the CD8 antibody is a multispecific CD8 antibody, wherein the third target is CD40L. In some embodiments of the methods, the CD8 antibody is a multispecific CD8 antibody, wherein the third target is HVEM. In some embodiments of the methods, the CD8 antibody is a multispecific CD8 antibody, wherein the third target is Galectin-9. In some embodiments of the methods, the CD8 antibody is a multispecific CD8 antibody, wherein the third target is TIM-1 In some embodiments of the methods, the CD8 antibody is a multispecific CD8 antibody, wherein the third target is LFA1 In some embodiments of the methods, the CD8 antibody is a multispecific CD8 antibody, wherein the third target is CD2. In some embodiments of the methods, the CD8 antibody is a multispecific CD8 antibody, wherein the third target is PD1. In some embodiments of the methods, the CD8 antibody is a multispecific CD8 antibody, wherein the fourth target is a TCR complex. In some embodiments of the methods, the CD8 antibody is a multispecific CD8 antibody, wherein the fourth target is CD3. In some embodiments of the methods, the CD8 antibody is a multispecific CD8 antibody, wherein the fourth target is CD3ε. In some embodiments of the methods, the CD8 antibody is a multispecific CD8 antibody, wherein the fourth target is CD3γ. In some embodiments of the methods, the CD8 antibody is a multispecific CD8 antibody, wherein the fourth target is CD3δ. In some embodiments of the methods, the CD8 antibody is a multispecific CD8 antibody, wherein the fourth target is CD3ζ. In some embodiments of the methods, the CD8 antibody is a multispecific CD8 antibody, wherein the fourth target is a TCRα chain. In some embodiments of the methods, the CD8 antibody is a multispecific CD8 antibody, wherein the fourth target is a TCRβ chain. In some embodiments of the methods, the CD8 antibody is a multispecific CD8 antibody, wherein the fourth target is a TCRγ chain. In some embodiments of the methods, the CD8 antibody is a multispecific CD8 antibody, wherein the fourth target is a TCRδ chain. In some embodiments of the methods, the CD8 antibody is a multispecific CD8 antibody, wherein the fourth target is a T cell costimulatory molecule. In some embodiments of the methods, the CD8 antibody is a multispecific CD8 antibody, wherein the fourth target is CD28. In some embodiments of the methods, the CD8 antibody is a multispecific CD8 antibody, wherein the fourth target is CTLA4. In some embodiments of the methods, the CD8 antibody is a multispecific CD8 antibody, wherein the fourth target is ICOS. In some embodiments of the methods, the CD8 antibody is a multispecific CD8 antibody, wherein the fourth target is 4-1BB. In some embodiments of the methods, the CD8 antibody is a multispecific CD8 antibody, wherein the fourth target is GITR. In some embodiments of the methods, the CD8 antibody is a multispecific CD8 antibody, wherein the fourth target is CD27. In some embodiments of the methods, the CD8 antibody is a multispecific CD8 antibody, wherein the fourth target is OX40. In some embodiments of the methods, the CD8 antibody is a multispecific CD8 antibody, wherein the fourth target is CD40L. In some embodiments of the methods, the CD8 antibody is a multispecific CD8 antibody, wherein the fourth target is HVEM. In some embodiments of the methods, the CD8 antibody is a multispecific CD8 antibody, wherein the fourth target is Galectin-9. In some embodiments of the methods, the CD8 antibody is a multispecific CD8 antibody, wherein the fourth target is TIM-1. In some embodiments of the methods, the CD8 antibody is a multispecific CD8 antibody, wherein the fourth target is LFA1. In some embodiments of the methods, the CD8 antibody is a multispecific CD8 antibody, wherein the fourth target is CD2. In some embodiments of the methods, the CD8 antibody is a multispecific CD8 antibody, wherein the fourth target is PD1. In some embodiments, the second target is CD4. In some embodiments of the methods, the CD8 antibody is a multispecific CD8 antibody, wherein the third target is CD3. In some embodiments of the methods, the CD8 antibody is a multispecific CD8 antibody, wherein the third target is TCRα chain. In some embodiments of the methods, the CD8 antibody is a multispecific CD8 antibody, wherein the third target is a TCRβ chain. In some embodiments of the methods, the CD8 antibody is a multispecific CD8 antibody, wherein the third target is a TCRγ chain. In some embodiments of the methods, the CD8 antibody is a multispecific CD8 antibody, wherein the third target is a TCRδ chain. In some embodiments of the methods, the CD8 antibody is a multispecific CD8 antibody, wherein the third target is CD28. In some embodiments of the methods, the CD8 antibody is a multispecific CD8 antibody, wherein the fourth target is CD28.

In some embodiments of the methods, the CD8 antibody is a multispecific CD8 antibody, wherein the second target is CD4, and the third target is a TCR complex. In some embodiments of the methods, the CD8 antibody is a multispecific CD8 antibody, wherein the second target is CD4, and the third target is CD3. In some embodiments of the methods, the CD8 antibody is a multispecific CD8 antibody, wherein the second target is CD4, and the third target is CD3ε. In some embodiments of the methods, the CD8 antibody is a multispecific CD8 antibody, wherein the second target is CD4, and the third target is CD3γ. In some embodiments of the methods, the CD8 antibody is a multispecific CD8 antibody, wherein the second target is CD4, and the third target is CD3δ. In some embodiments of the methods, the CD8 antibody is a multispecific CD8 antibody, wherein the second target is CD4, and the third target is CD3ζ. In some embodiments of the methods, the CD8 antibody is a multispecific CD8 antibody, wherein the second target is CD4, and the third target is a TCRα chain. In some embodiments of the methods, the CD8 antibody is a multispecific CD8 antibody, wherein the second target is CD4, and the third target is a TCRβ chain. In some embodiments of the methods, the CD8 antibody is a multispecific CD8 antibody, wherein the second target is CD4, and the third target is a TCRγ chain.

In some embodiments of the methods, the CD8 antibody is a multispecific CD8 antibody, wherein the second target is CD4, and the third target is a T cell costimulatory molecule. In some embodiments of the methods, the CD8 antibody is a multispecific CD8 antibody, wherein the second target is CD4, and the third target is CD28. In some embodiments of the methods, the CD8 antibody is a multispecific CD8 antibody, wherein the second target is CD4, and the third target is CTLA4. In some embodiments of the methods, the CD8 antibody is a multispecific CD8 antibody, wherein the second target is CD4, and the third target is ICOS. In some embodiments of the methods, the CD8 antibody is a multispecific CD8 antibody, wherein the second target is CD4, and the third target is 4-1BB. In some embodiments of the methods, the CD8 antibody is a multispecific CD8 antibody, wherein the second target is CD4, and the third target is GITR. In some embodiments of the methods, the CD8 antibody is a multispecific CD8 antibody, wherein the second target is CD4, and the third target is CD27. In some embodiments of the methods, the CD8 antibody is a multispecific CD8 antibody, wherein the second target is CD4, and the third target is OX40. In some embodiments of the methods, the CD8 antibody is a multispecific CD8 antibody, wherein the second target is CD4, and the third target is CD40L. In some embodiments of the methods, the CD8 antibody is a multispecific CD8 antibody, wherein the second target is CD4, and the third target is HVEM. In some embodiments of the methods, the CD8 antibody is a multispecific CD8 antibody, wherein the second target is CD4, and the third target is Galectin-9. In some embodiments of the methods, the CD8 antibody is a multispecific CD8 antibody, wherein the second target is CD4, and the third target is TIM-1. In some embodiments of the methods, the CD8 antibody is a multispecific CD8 antibody, wherein the second target is CD4, and the third target is LFA1. In some embodiments of the methods, the CD8 antibody is a multispecific CD8 antibody, wherein the second target is CD4, and the third target is CD2. In some embodiments of the methods, the CD8 antibody is a multispecific CD8 antibody, wherein the second target is CD4, and the third target is PD1.

In some embodiments of the methods, the CD8 antibody is a multispecific CD8 antibody, wherein the second target is CD4, the third target is a TCR complex, and the fourth target is a T cell costimulatory molecule. In some embodiments of the methods, the CD8 antibody is a multispecific CD8 antibody, wherein the second target is CD4, the third target is CD3, and the fourth target is a T cell costimulatory molecule. In some embodiments of the methods, the CD8 antibody is a multispecific CD8 antibody, wherein the second target is CD4, the third target is CD3ε, and the fourth target is a T cell costimulatory molecule. In some embodiments of the methods, the CD8 antibody is a multispecific CD8 antibody, wherein the second target is CD4, the third target is CD3γ, and the fourth target is a T cell costimulatory molecule. In some embodiments of the methods, the CD8 antibody is a multispecific CD8 antibody, wherein the second target is CD4, the third target is CD3δ, and the fourth target is a T cell costimulatory molecule. In some embodiments of the methods, the CD8 antibody is a multispecific CD8 antibody, wherein the second target is CD4, the third target is CD3ζ, and the fourth target is a T cell costimulatory molecule. In some embodiments of the methods, the CD8 antibody is a multispecific CD8 antibody, wherein the second target is CD4, the third target is a TCRα chain, and the fourth target is a T cell costimulatory molecule. In some embodiments of the methods, the CD8 antibody is a multispecific CD8 antibody, wherein the second target is CD4, the third target is a TCRβ chain, and the fourth target is a T cell costimulatory molecule. In some embodiments of the methods, the CD8 antibody is a multispecific CD8 antibody, wherein the second target is CD4, the third target is a TCRγ chain, and the fourth target is a T cell costimulatory molecule. In certain embodiments, the T cell costimulatory molecule is CD28. In certain embodiments, the T cell costimulatory molecule is CTLA4. In certain embodiments, the T cell costimulatory molecule is ICOS. In certain embodiments, the T cell costimulatory molecule is 4-1BB. In certain embodiments, the T cell costimulatory molecule is GITR. In certain embodiments, the T cell costimulatory molecule is CD27. In certain embodiments, the T cell costimulatory molecule is OX40. In certain embodiments, the T cell costimulatory molecule is CD40L. In certain embodiments, the T cell costimulatory molecule is HVEM. In certain embodiments, the T cell costimulatory molecule is Galectin-9. In certain embodiments, the T cell costimulatory molecule is TIM-1. In certain embodiments, the T cell costimulatory molecule is LFA1. In certain embodiments, the T cell costimulatory molecule is CD2. In certain embodiments, the T cell costimulatory molecule is PD1.

In some embodiments of the methods, the CD8 antibody is a multispecific CD8 antibody, wherein the second target is a TCR complex, and the third target is a T cell costimulatory molecule. In some embodiments of the methods, the CD8 antibody is a multispecific CD8 antibody, wherein the second target is CD3, and the third target is a T cell costimulatory molecule. In some embodiments of the methods, the CD8 antibody is a multispecific CD8 antibody, wherein the second target is CD3ε, and the third target is a T cell costimulatory molecule. In some embodiments of the methods, the CD8 antibody is a multispecific CD8 antibody, wherein the second target is CD3γ, and the third target is a T cell costimulatory molecule. In some embodiments of the methods, the CD8 antibody is a multispecific CD8 antibody, wherein the second target is CD3δ, and the third target is a T cell costimulatory molecule. In some embodiments of the methods, the CD8 antibody is a multispecific CD8 antibody, wherein the second target is CD3ζ, and the third target is a T cell costimulatory molecule. In some embodiments of the methods, the CD8 antibody is a multispecific CD8 antibody, wherein the second target is a TCRα chain, and the third target is a T cell costimulatory molecule. In some embodiments of the methods, the CD8 antibody is a multispecific CD8 antibody, wherein the second target is a TCRβ chain, and the third target is a T cell costimulatory molecule. In some embodiments of the methods, the CD8 antibody is a multispecific CD8 antibody, wherein the second target is a TCRγ chain, and the third target is a T cell costimulatory molecule. In certain embodiments, the T cell costimulatory molecule is CD28. In certain embodiments, the T cell costimulatory molecule is CTLA4. In certain embodiments, the T cell costimulatory molecule is ICOS. In certain embodiments, the T cell costimulatory molecule is 4-1BB. In certain embodiments, the T cell costimulatory molecule is GITR. In certain embodiments, the T cell costimulatory molecule is CD27. In certain embodiments, the T cell costimulatory molecule is OX40. In certain embodiments, the T cell costimulatory molecule is CD40L. In certain embodiments, the T cell costimulatory molecule is HVEM. In certain embodiments, the T cell costimulatory molecule is Galectin-9. In certain embodiments, the T cell costimulatory molecule is TIM-1. In certain embodiments, the T cell costimulatory molecule is LFA1. In certain embodiments, the T cell costimulatory molecule is CD2. In certain embodiments, the T cell costimulatory molecule is PD1.

In specific embodiments of the methods provided herein, the method uses multi-marker detection. In some embodiments, the multi-marker detection uses a multispecific CD8 antibody provided herein. In some embodiments, the multi-marker detection uses a bispecific CD8 antibody provided herein. In some embodiments, the multi-marker detection uses a trispecific CD8 antibody provided herein. In some embodiments, the multi-marker detection uses a quadraspecific CD8 antibody provided herein.

In certain embodiments of the methods provided herein, the methods are included as steps in a T cell manufacturing process. In certain embodiments, the cells are CAR-T cells. In certain embodiments of the methods provided herein, the methods are included as steps in a T cell modification process.

In certain embodiments of the methods provided herein, the methods are included as steps in a diagnostic method. In certain embodiments of the methods provided herein, the methods are included as steps in a method to quantify the CD8-expressing T cells.

In certain embodiments of the methods provided herein, the method further comprises expanding the enriched, isolated, separated, purified, sorted, selected, captured or detected CD8-expressing cells. In certain embodiments, the expanding is in vitro. In certain embodiments, the expanding is in vivo. In certain embodiments of the methods provided herein, the method further comprises growing the enriched, isolated, separated, purified, sorted, selected, captured or detected CD8-expressing cells. In certain embodiments, the growing is in vitro. In certain embodiments, the growing is in vivo. In certain embodiments of the methods provided herein, the method further comprises quantifying the enriched, isolated, separated, purified, sorted, selected, captured or detected CD8-expressing cells.

In another aspect, the CD4 antibodies provided herein are used as agents to detect CD4-expressing cells. Thus, in other methods, provided is a method of detecting a cell expressing CD4, comprising contacting a cell with a CD4 antibody provided herein. In certain embodiments, the detecting is by ELISA. In some embodiments, the detecting is by FACS analysis. Also provided are kits comprising a CD4 antibody provided herein, and instructions for use.

Enrichment, isolation, separation, purification, sorting, selecting, capturing or detecting, or any combination thereof can be done using known technologies such as bead, microfluidics, solid support, columns, and the like. For example, CD4+ T cells, such as T helper cells, may be separated or visualized using known methods when bound to the CD4 antibodies provided herein.

The CD4 antibodies or multispecific CD4 antibodies provided herein can be used to selectively enrich, isolate, separate, purify, sort, select, capture or detect CD4-expressing cells. The CD4 antibodies or multispecific CD4 antibodies provided herein may be utilized in a bispecific format, e.g. containing a first antigen binding domain that specifically binds CD4 and a second antigen binding domain that specifically binds a second target. In other embodiments, the multispecific CD4 antibodies provided herein may be utilized in a format that further incorporates a third antigen binding domain that specifically binds a third antigen (e.g., at a trispecific antibody). In other embodiments, the multispecific CD4 antibodies provided herein may be utilized in a format that further incorporates a fourth antigen binding domain that specifically binds a fourth antigen. (e.g., as a quadraspecific antibody).

In one aspect, provided herein is a method of enriching a CD4-expressing cell comprising: providing a sample comprising the CD4-expressing cell; contacting the sample with a CD4 antibody provided herein; and enriching the CD4-expressing cell bound to the CD4 antibody. In one aspect, provided herein is a method of isolating a CD4-expressing cell comprising: providing a sample comprising the CD4-expressing cell; contacting the sample with a CD4 antibody provided herein; and isolating the CD4-expressing cell bound to the CD4 antibody. In one aspect, provided herein is a method of separating a CD4-expressing cell comprising: providing a sample comprising the CD4-expressing cell; contacting the sample with a CD4 antibody provided herein;

and separating the CD4-expressing cell bound to the CD4 antibody. In one aspect, provided herein is a method of purifying a CD4-expressing cell comprising: providing a sample comprising the CD4-expressing cell; contacting the sample with a CD4 antibody provided herein; and purifying the CD4-expressing cell bound to the CD4 antibody. In one aspect, provided herein is a method of sorting a CD4-expressing cell comprising: providing a sample comprising the CD4-expressing cell; contacting the sample with a CD4 antibody provided herein; and sorting the CD4-expressing cell bound to the CD4 antibody. In one aspect, provided herein is a method of selecting a CD4-expressing cell comprising: providing a sample comprising the CD4-expressing cell; contacting the sample with a CD4 antibody provided herein; and selecting the CD4-expressing cell bound to the CD4 antibody. In one aspect, provided herein is a method of capturing a CD4-expressing cell comprising: providing a sample comprising the CD4-expressing cell; contacting the sample with a CD4 antibody provided herein; and capturing the CD4-expressing cell bound to the CD4 antibody. In one aspect, provided herein is a method of detecting a CD4-expressing cell comprising: providing a sample comprising the CD4-expressing cell; contacting the sample with a CD4 antibody provided herein; and detecting the CD4-expressing cell bound to the CD4 antibody.

In one aspect, provided herein is a method of enriching a CD4-expressing cell comprising: contacting a CD4-expressing cell with a CD4 antibody provided herein; and enriching the CD4-expressing cell bound to the CD4 antibody. In one aspect, provided herein is a method of isolating a CD4-expressing cell comprising: contacting a CD4-expressing cell with a CD4 antibody provided herein; and isolating the CD4-expressing cell bound to the CD4 antibody. In one aspect, provided herein is a method of separating a CD4-expressing cell comprising: contacting a CD4-expressing cell with a CD4 antibody provided herein; and separating the CD4-expressing cell bound to the CD4 antibody. In one aspect, provided herein is a method of purifying a CD4-expressing cell comprising: contacting a CD4-expressing cell with a CD4 antibody provided herein; and purifying the CD4-expressing cell bound to the CD4 antibody. In one aspect, provided herein is a method of sorting a CD4-expressing cell comprising: contacting a CD4-expressing cell with a CD4 antibody provided herein; and sorting the CD4-expressing cell bound to the CD4 antibody. In one aspect, provided herein is a method of selecting a CD4-expressing cell comprising: contacting a CD4-expressing cell with a CD4 antibody provided herein; and selecting the CD4-expressing cell bound to the CD4 antibody. In one aspect, provided herein is a method of capturing a CD4-expressing cell comprising: contacting a CD4-expressing cell with a CD4 antibody provided herein; and capturing the CD4-expressing cell bound to the CD4 antibody. In one aspect, provided herein is a method of detecting a CD4-expressing cell comprising: contacting a CD4-expressing cell with a CD4 antibody provided herein; and detecting the CD4-expressing cell bound to the CD4 antibody.

In one aspect, provided herein is a method of enriching a CD4-expressing cell comprising: contacting a CD4-expressing cell with a CD4 antibody provided herein; and enriching the CD4-expressing cell based on binding of the CD4-expressing cell to the CD4 antibody. In one aspect, provided herein is a method of isolating a CD4-expressing cell comprising: contacting a CD4-expressing cell with a CD4 antibody provided herein; and isolating the CD4-expressing cell based on binding of the CD4-expressing cell to the CD4 antibody. In one aspect, provided herein is a method of separating a CD4-expressing cell comprising: contacting a CD4-expressing cell with a CD4 antibody provided herein; and separating the CD4-expressing cell based on binding of the CD4-expressing cell to the CD4 antibody. In one aspect, provided herein is a method of purifying a CD4-expressing cell comprising: contacting a CD4-expressing cell with a CD4 antibody provided herein; and purifying the CD4-expressing cell based on binding of the CD4-expressing cell to the CD4 antibody. In one aspect, provided herein is a method of sorting a CD4-expressing cell comprising: contacting a CD4-expressing cell with a CD4 antibody provided herein; and sorting the CD4-expressing cell based on binding of the CD4-expressing cell to the CD4 antibody. In one aspect, provided herein is a method of selecting a CD4-expressing cell comprising: contacting a CD4-expressing cell with a CD4 antibody provided herein; and selecting the CD4-expressing cell based on binding of the CD4-expressing cell to the CD4 antibody. In one aspect, provided herein is a method of capturing a CD4-expressing cell comprising: contacting a CD4-expressing cell with a CD4 antibody provided herein; and capturing the CD4-expressing cell based on binding of the CD4-expressing cell to the CD4 antibody. In one aspect, provided herein is a method of detecting a CD4-expressing cell comprising: contacting a CD4-expressing cell with a CD4 antibody provided herein; and detecting the CD4-expressing cell based on binding of the CD4-expressing cell to the CD4 antibody.

In certain embodiments of the methods, the CD4-expressing cell is a T cell. In certain embodiments of the methods, the CD4-expressing cell is a CD4+ T helper cell. In some embodiments of the methods, the CD4-expressing cell is in a population of cells. In some embodiments of the methods, the CD4-expressing cell is in a population of lymphocytes. In some embodiments of the methods, the CD4-expressing cell is in a population of T cells. In some embodiments of the methods, the CD4-expressing cell is provided as a population of cells. In some embodiments of the methods, the CD4-expressing cell is provided as a population of lymphocytes. In some embodiments of the methods, the CD4-expressing cell is provided as a population of T cells. In some embodiments of the methods, the CD4-expressing cell is provided as a sample comprising a population of cells. In some embodiments of the methods, the CD4-expressing cell is provided as a sample comprising a population of lymphocytes. In some embodiments of the methods, the CD4-expressing cell is provided as a sample comprising a population of T cells. In some embodiments of the methods, the sample is a blood sample. In some embodiments of the methods, the sample is a tissue sample. In some embodiments of the methods, the sample is a tissue culture sample.

In some embodiments of the methods, the CD4 antibody is a multispecific CD4 antibody provided herein. In some embodiments of the methods, the CD4 antibody is a bispecific CD4 antibody provided herein. In some embodiments of the methods, the CD4 antibody is a trispecific CD4 antibody provided herein. In some embodiments of the methods, the CD4 antibody is a quadraspecific CD4 antibody provided herein. In certain embodiments, the CD4 antibody specifically binds to CD4. In one embodiment, the multispecific CD4 antibody comprises: (a) a first binding domain that binds CD4, and (b) a second binding domain that binds to a second target. In one embodiment, the multispecific CD4 antibody comprises: (a) a first binding domain that binds CD4, and (b) a second binding domain that binds to a second target, and (c) a third binding domain that binds to a third target. In one embodiment, the multispecific CD4 antibody comprises: (a) a first binding domain that binds CD4, and (b) a second binding domain that binds to a second target, (c) a third binding domain that binds to a third target, and (d) a fourth binding domain that binds to a fourth target. In one embodiment, the multispecific CD4 antibody comprises: (a) a first binding domain that specifically binds CD4, and (b) a second binding domain that specifically binds to a second target. In one embodiment, the multispecific CD4 antibody comprises: (a) a first binding domain that specifically binds CD4, and (b) a second binding domain that specifically binds to a second target, and (c) a third binding domain that specifically binds to a third target. In one embodiment, the multispecific CD4 antibody comprises: (a) a first binding domain that specifically binds CD4, and (b) a second binding domain that specifically binds to a second target, (c) a third binding domain that specifically binds to a third target, and (d) a fourth binding domain that specifically binds to a fourth target.

In some embodiments of the methods, the CD4 antibody is a multispecific CD4 antibody, wherein the second target is CD8. In some embodiments, the second target is a TCR complex. In some embodiments of the methods, the CD4 antibody is a multispecific CD4 antibody, wherein the second target is CD3. In some embodiments, CD3 comprises CD3ε. In some embodiments, CD3 comprises CD3γ. In some embodiments, CD3 comprises CD3δ. In some embodiments, CD3 comprises CD3ζ. In some embodiments of the methods, the CD4 antibody is a multispecific CD4 antibody, wherein the second target is CD3ε. In some embodiments of the methods, the CD4 antibody is a multispecific CD4 antibody, wherein the second target is CD3γ. In some embodiments of the methods, the CD4 antibody is a multispecific CD4 antibody, wherein the second target is CD3δ. In some embodiments of the methods, the CD4 antibody is a multispecific CD4 antibody, wherein the second target is CD3ζ. In some embodiments of the methods, the CD4 antibody is a multispecific CD4 antibody, wherein the second target is a TCRα chain. In some embodiments of the methods, the CD4 antibody is a multispecific CD4 antibody, wherein the second target is a TCRβ chain. In some embodiments of the methods, the CD4 antibody is a multispecific CD4 antibody, wherein the second target is a TCRγ chain. In some embodiments of the methods, the CD4 antibody is a multispecific CD4 antibody, wherein the second target is a TCRδ chain. In some embodiments of the methods, the CD4 antibody is a multispecific CD4 antibody, wherein the second target is a T cell costimulatory molecule. In some embodiments of the methods, the CD4 antibody is a multispecific CD4 antibody, wherein the second target is CD28. In some embodiments of the methods, the CD4 antibody is a multispecific CD4 antibody, wherein the second target is CTLA4. In some embodiments of the methods, the CD4 antibody is a multispecific CD4 antibody, wherein the second target is ICOS. In some embodiments of the methods, the CD4 antibody is a multispecific CD4 antibody, wherein the second target is 4-1BB. In some embodiments of the methods, the CD4 antibody is a multispecific CD4 antibody, wherein the second target is GITR. In some embodiments of the methods, the CD4 antibody is a multispecific CD4 antibody, wherein the second target is CD27. In some embodiments of the methods, the CD4 antibody is a multispecific CD4 antibody, wherein the second target is OX40. In some embodiments of the methods, the CD4 antibody is a multispecific CD4 antibody, wherein the second target is CD40L. In some embodiments of the methods, the CD4 antibody is a multispecific CD4 antibody, wherein the second target is HVEM. In some embodiments of the methods, the CD4 antibody is a multispecific CD4 antibody, wherein the second target is Galectin-9. In some embodiments of the methods, the CD4 antibody is a multispecific CD4 antibody, wherein the second target is TIM-1. In some embodiments of the methods, the CD4 antibody is a multispecific CD4 antibody, wherein the second target is LFA1. In some embodiments of the methods, the CD4 antibody is a multispecific CD4 antibody, wherein the second target is CD2. In some embodiments of the methods, the CD4 antibody is a multispecific CD4 antibody, wherein the second target is PD1. In some embodiments of the methods, the CD4 antibody is a multispecific CD4 antibody, wherein the third target is a TCR complex. In some embodiments of the methods, the CD4 antibody is a multispecific CD4 antibody, wherein the third target is CD3. In some embodiments of the methods, the CD4 antibody is a multispecific CD4 antibody, wherein the third target is CD3ε. In some embodiments of the methods, the CD4 antibody is a multispecific CD4 antibody, wherein the third target is CD3γ. In some embodiments of the methods, the CD4 antibody is a multispecific CD4 antibody, wherein the third target is CD3δ. In some embodiments of the methods, the CD4 antibody is a multispecific CD4 antibody, wherein the third target is CD3ζ. In some embodiments of the methods, the CD4 antibody is a multispecific CD4 antibody, wherein the third target is a TCRα chain. In some embodiments of the methods, the CD4 antibody is a multispecific CD4 antibody, wherein the third target is a TCRβ chain. In some embodiments of the methods, the CD4 antibody is a multispecific CD4 antibody, wherein the third target is a TCRγ chain. In some embodiments of the methods, the CD4 antibody is a multispecific CD4 antibody, wherein the third target is a TCRδ chain. In some embodiments of the methods, the CD4 antibody is a multispecific CD4 antibody, wherein the third target is a T cell costimulatory molecule. In some embodiments of the methods, the CD4 antibody is a multispecific CD4 antibody, wherein the third target is CD28. In some embodiments of the methods, the CD4 antibody is a multispecific CD4 antibody, wherein the third target is CTLA4. In some embodiments of the methods, the CD4 antibody is a multispecific CD4 antibody, wherein the third target is ICOS. In some embodiments of the methods, the CD4 antibody is a multispecific CD4 antibody, wherein the third target is 4-1BB. In some embodiments of the methods, the CD4 antibody is a multispecific CD4 antibody, wherein the third target is GITR. In some embodiments of the methods, the CD4 antibody is a multispecific CD4 antibody, wherein the third target is CD27. In some embodiments of the methods, the CD4 antibody is a multispecific CD4 antibody, wherein the third target is OX40. In some embodiments of the methods, the CD4 antibody is a multispecific CD4 antibody, wherein the third target is CD40L. In some embodiments of the methods, the CD4 antibody is a multispecific CD4 antibody, wherein the third target is HVEM. In some embodiments of the methods, the CD4 antibody is a multispecific CD4 antibody, wherein the third target is Galectin-9. In some embodiments of the methods, the CD4 antibody is a multispecific CD4 antibody, wherein the third target is TIM-1. In some embodiments of the methods, the CD4 antibody is a multispecific CD4 antibody, wherein the third target is LFA1. In some embodiments of the methods, the CD4 antibody is a multispecific CD4 antibody, wherein the third target is CD2. In some embodiments of the methods, the CD4 antibody is a multispecific CD4 antibody, wherein the third target is PD1. In some embodiments of the methods, the CD4 antibody is a multispecific CD4 antibody, wherein the fourth target is a TCR complex. In some embodiments of the methods, the CD4 antibody is a multispecific CD4 antibody, wherein the fourth target is CD3. In some embodiments of the methods, the CD4 antibody is a multispecific CD4 antibody, wherein the fourth target is CD3ε. In some embodiments of the methods, the CD4 antibody is a multispecific CD4 antibody, wherein the fourth target is CD3γ. In some embodiments of the methods, the CD4 antibody is a multispecific CD4 antibody, wherein the fourth target is CD3δ. In some embodiments of the methods, the CD4 antibody is a multispecific CD4 antibody, wherein the fourth target is CD3ζ. In some embodiments of the methods, the CD4 antibody is a multispecific CD4 antibody, wherein the fourth target is a TCRα chain. In some embodiments of the methods, the CD4 antibody is a multispecific CD4 antibody, wherein the fourth target is a TCRβ chain. In some embodiments of the methods, the CD4 antibody is a multispecific CD4 antibody, wherein the fourth target is a TCRγ chain. In some embodiments of the methods, the CD4 antibody is a multispecific CD4 antibody, wherein the fourth target is a TCRδ chain. In some embodiments of the methods, the CD4 antibody is a multispecific CD4 antibody, wherein the fourth target is a T cell costimulatory molecule. In some embodiments of the methods, the CD4 antibody is a multispecific CD4 antibody, wherein the fourth target is CD28. In some embodiments of the methods, the CD4 antibody is a multispecific CD4 antibody, wherein the fourth target is CTLA4. In some embodiments of the methods, the CD4 antibody is a multispecific CD4 antibody, wherein the fourth target is ICOS. In some embodiments of the methods, the CD4 antibody is a multispecific CD4 antibody, wherein the fourth target is 4-1BB. In some embodiments of the methods, the CD4 antibody is a multispecific CD4 antibody, wherein the fourth target is GITR. In some embodiments of the methods, the CD4 antibody is a multispecific CD4 antibody, wherein the fourth target is CD27. In some embodiments of the methods, the CD4 antibody is a multispecific CD4 antibody, wherein the fourth target is OX40. In some embodiments of the methods, the CD4 antibody is a multispecific CD4 antibody, wherein the fourth target is CD40L. In some embodiments of the methods, the CD4 antibody is a multispecific CD4 antibody, wherein the fourth target is HVEM. In some embodiments of the methods, the CD4 antibody is a multispecific CD4 antibody, wherein the fourth target is Galectin-9. In some embodiments of the methods, the CD4 antibody is a multispecific CD4 antibody, wherein the fourth target is TIM-1. In some embodiments of the methods, the CD4 antibody is a multispecific CD4 antibody, wherein the fourth target is LFA1. In some embodiments of the methods, the CD4 antibody is a multispecific CD4 antibody, wherein the fourth target is CD2. In some embodiments of the methods, the CD4 antibody is a multispecific CD4 antibody, wherein the fourth target is PD1. In some embodiments, the second target is CD8. In some embodiments of the methods, the CD4 antibody is a multispecific CD4 antibody, wherein the third target is CD3. In some embodiments of the methods, the CD4 antibody is a multispecific CD4 antibody, wherein the third target is TCRα chain. In some embodiments of the methods, the CD4 antibody is a multispecific CD4 antibody, wherein the third target is a TCRβ chain. In some embodiments of the methods, the CD4 antibody is a multispecific CD4 antibody, wherein the third target is a TCRγ chain. In some embodiments of the methods, the CD4 antibody is a multispecific CD4 antibody, wherein the third target is a TCRδ chain. In some embodiments of the methods, the CD4 antibody is a multispecific CD4 antibody, wherein the third target is CD28. In some embodiments of the methods, the CD4 antibody is a multispecific CD4 antibody, wherein the fourth target is CD28.

In some embodiments of the methods, the CD4 antibody is a multispecific CD4 antibody, wherein the second target is CD8, and the third target is a TCR complex. In some embodiments of the methods, the CD4 antibody is a multispecific CD4 antibody, wherein the second target is CD8, and the third target is CD3. In some embodiments of the methods, the CD4 antibody is a multispecific CD4 antibody, wherein the second target is CD8, and the third target is CD3ε. In some embodiments of the methods, the CD4 antibody is a multispecific CD4 antibody, wherein the second target is CD8, and the third target is CD3γ. In some embodiments of the methods, the CD4 antibody is a multispecific CD4 antibody, wherein the second target is CD8, and the third target is CD3δ. In some embodiments of the methods, the CD4 antibody is a multispecific CD4 antibody, wherein the second target is CD8, and the third target is CD3ζ. In some embodiments of the methods, the CD4 antibody is a multispecific CD4 antibody, wherein the second target is CD8, and the third target is a TCRα chain. In some embodiments of the methods, the CD4 antibody is a multispecific CD4 antibody, wherein the second target is CD8, and the third target is a TCRβ chain. In some embodiments of the methods, the CD4 antibody is a multispecific CD4 antibody, wherein the second target is CD8, and the third target is a TCRγ chain.

In some embodiments of the methods, the CD4 antibody is a multispecific CD4 antibody, wherein the second target is CD8, and the third target is a T cell costimulatory molecule. In some embodiments of the methods, the CD4 antibody is a multispecific CD4 antibody, wherein the second target is CD8, and the third target is CD28. In some embodiments of the methods, the CD4 antibody is a multispecific CD4 antibody, wherein the second target is CD8, and the third target is CTLA4. In some embodiments of the methods, the CD4 antibody is a multispecific CD4 antibody, wherein the second target is CD8, and the third target is ICOS. In some embodiments of the methods, the CD4 antibody is a multispecific CD4 antibody, wherein the second target is CD8, and the third target is 4-1BB. In some embodiments of the methods, the CD4 antibody is a multispecific CD4 antibody, wherein the second target is CD8, and the third target is GITR. In some embodiments of the methods, the CD4 antibody is a multispecific CD4 antibody, wherein the second target is CD8, and the third target is CD27. In some embodiments of the methods, the CD4 antibody is a multispecific CD4 antibody, wherein the second target is CD8, and the third target is OX40. In some embodiments of the methods, the CD4 antibody is a multispecific CD4 antibody, wherein the second target is CD8, and the third target is CD40L. In some embodiments of the methods, the CD4 antibody is a multispecific CD4 antibody, wherein the second target is CD8, and the third target is HVEM. In some embodiments of the methods, the CD4 antibody is a multispecific CD4 antibody, wherein the second target is CD8, and the third target is Galectin-9. In some embodiments of the methods, the CD4 antibody is a multispecific CD4 antibody, wherein the second target is CD8, and the third target is TIM-1. In some embodiments of the methods, the CD4 antibody is a multispecific CD4 antibody, wherein the second target is CD8, and the third target is LFA1. In some embodiments of the methods, the CD4 antibody is a multispecific CD4 antibody, wherein the second target is CD8, and the third target is CD2. In some embodiments of the methods, the CD4 antibody is a multispecific CD4 antibody, wherein the second target is CD8, and the third target is PD1.

In some embodiments of the methods, the CD4 antibody is a multispecific CD4 antibody, wherein the second target is CD8, the third target is a TCR complex, and the fourth target is a T cell costimulatory molecule. In some embodiments of the methods, the CD4 antibody is a multispecific CD4 antibody, wherein the second target is CD8, the third target is CD3, and the fourth target is a T cell costimulatory molecule. In some embodiments of the methods, the CD4 antibody is a multispecific CD4 antibody, wherein the second target is CD8, the third target is CD3ε, and the fourth target is a T cell costimulatory molecule. In some embodiments of the methods, the CD4 antibody is a multispecific CD4 antibody, wherein the second target is CD8, the third target is CD3γ, and the fourth target is a T cell costimulatory molecule. In some embodiments of the methods, the CD4 antibody is a multispecific CD4 antibody, wherein the second target is CD8, the third target is CD3δ, and the fourth target is a T cell costimulatory molecule. In some embodiments of the methods, the CD4 antibody is a multispecific CD4 antibody, wherein the second target is CD8, the third target is CD3ζ, and the fourth target is a T cell costimulatory molecule. In some embodiments of the methods, the CD4 antibody is a multispecific CD4 antibody, wherein the second target is CD8, the third target is a TCRα chain, and the fourth target is a T cell costimulatory molecule. In some embodiments of the methods, the CD4 antibody is a multispecific CD4 antibody, wherein the second target is CD8, the third target is a TCRβ chain, and the fourth target is a T cell costimulatory molecule. In some embodiments of the methods, the CD4 antibody is a multispecific CD4 antibody, wherein the second target is CD8, the third target is a TCRγ chain, and the fourth target is a T cell costimulatory molecule. In certain embodiments, the T cell costimulatory molecule is CD28. In certain embodiments, the T cell costimulatory molecule is CTLA4. In certain embodiments, the T cell costimulatory molecule is ICOS. In certain embodiments, the T cell costimulatory molecule is 4-1BB. In certain embodiments, the T cell costimulatory molecule is GITR. In certain embodiments, the T cell costimulatory molecule is CD27. In certain embodiments, the T cell costimulatory molecule is OX40. In certain embodiments, the T cell costimulatory molecule is CD40L. In certain embodiments, the T cell costimulatory molecule is HVEM. In certain embodiments, the T cell costimulatory molecule is Galectin-9. In certain embodiments, the T cell costimulatory molecule is TIM-1. In certain embodiments, the T cell costimulatory molecule is LFA1. In certain embodiments, the T cell costimulatory molecule is CD2. In certain embodiments, the T cell costimulatory molecule is PD1.

In some embodiments of the methods, the CD4 antibody is a multispecific CD4 antibody, wherein the second target is a TCR complex, and the third target is a T cell costimulatory molecule. In some embodiments of the methods, the CD4 antibody is a multispecific CD4 antibody, wherein the second target is CD3, and the third target is a T cell costimulatory molecule. In some embodiments of the methods, the CD4 antibody is a multispecific CD4 antibody, wherein the second target is CD3ε, and the third target is a T cell costimulatory molecule. In some embodiments of the methods, the CD4 antibody is a multispecific CD4 antibody, wherein the second target is CD3γ, and the third target is a T cell costimulatory molecule. In some embodiments of the methods, the CD4 antibody is a multispecific CD4 antibody, wherein the second target is CD3δ, and the third target is a T cell costimulatory molecule. In some embodiments of the methods, the CD4 antibody is a multispecific CD4 antibody, wherein the second target is CD3ζ, and the third target is a T cell costimulatory molecule. In some embodiments of the methods, the CD4 antibody is a multispecific CD4 antibody, wherein the second target is a TCRα chain, and the third target is a T cell costimulatory molecule. In some embodiments of the methods, the CD4 antibody is a multispecific CD4 antibody, wherein the second target is a TCRβ chain, and the third target is a T cell costimulatory molecule. In some embodiments of the methods, the CD4 antibody is a multispecific CD4 antibody, wherein the second target is a TCRγ chain, and the third target is a T cell costimulatory molecule. In certain embodiments, the T cell costimulatory molecule is CD28. In certain embodiments, the T cell costimulatory molecule is CTLA4. In certain embodiments, the T cell costimulatory molecule is ICOS. In certain embodiments, the T cell costimulatory molecule is 4-1BB. In certain embodiments, the T cell costimulatory molecule is GITR. In certain embodiments, the T cell costimulatory molecule is CD27. In certain embodiments, the T cell costimulatory molecule is OX40. In certain embodiments, the T cell costimulatory molecule is CD40L. In certain embodiments, the T cell costimulatory molecule is HVEM. In certain embodiments, the T cell costimulatory molecule is Galectin-9. In certain embodiments, the T cell costimulatory molecule is TIM-1. In certain embodiments, the T cell costimulatory molecule is LFA1. In certain embodiments, the T cell costimulatory molecule is CD2. In certain embodiments, the T cell costimulatory molecule is PD1.

In specific embodiments of the methods provided herein, the method uses multi-marker detection. In some embodiments, the multi-marker detection uses a multispecific CD4 antibody provided herein. In some embodiments, the multi-marker detection uses a bispecific CD4 antibody provided herein. In some embodiments, the multi-marker detection uses a trispecific CD4 antibody provided herein. In some embodiments, the multi-marker detection uses a quadraspecific CD4 antibody provided herein.

In certain embodiments of the methods provided herein, the methods are included as steps in a diagnostic method. In certain embodiments of the methods provided herein, the methods are included as steps in a method to quantify the CD4-expressing T cells.

In certain embodiments of the methods provided herein, the method further comprises expanding the enriched, isolated, separated, purified, sorted, selected, captured or detected CD4-expressing cells. In certain embodiments, the expanding is in vitro. In certain embodiments, the expanding is in vivo. In certain embodiments of the methods provided herein, the method further comprises growing the enriched, isolated, separated, purified, sorted, selected, captured or detected CD4-expressing cells. In certain embodiments, the growing is in vitro. In certain embodiments, the growing is in vivo. In certain embodiments of the methods provided herein, the method further comprises quantifying the enriched, isolated, separated, purified, sorted, selected, captured or detected CD4-expressing cells.

In another aspect, the multispecific CD4/CD8 antibodies provided herein are used as agents to detect CD4-expressing cells and/or CD8-expressing cells. Thus, in other methods, provided is a method of detecting a cell expressing CD4 and/or CD8, comprising contacting a cell with a multispecific CD4/CD8 antibody provided herein. In certain embodiments, the detecting is by ELISA. In some embodiments, the detecting is by FACS analysis. Also provided are kits comprising a CD4 antibody provided herein, and instructions for use.

Enrichment, isolation, separation, purification, sorting, selecting, capturing or detecting, or any combination thereof can be done using known technologies such as bead, microfluidics, solid support, columns, and the like. For example, CD4+ T cells, such as T helper cells, may be separated or visualized using known methods when bound to the multispecific CD4/CD8 antibodies provided herein. In addition, for example, CD8+ T cells, such as CTL, may be separated or visualized using known methods when bound to the multispecific CD4/CD8 antibodies provided herein.

The multispecific CD4/CD8 antibodies provided herein can be used to selectively enrich, isolate, separate, purify, sort, select, capture or detect CD4-expressing cells and/or CD8-expressing cells. The multispecific CD4/CD8 antibodies provided herein may be utilized in a bispecific format, e.g. containing a first antigen binding domain that specifically binds CD8 and a second antigen binding domain that specifically binds CD4. In other embodiments, the multispecific CD4/CD8 antibodies provided herein may be utilized in a format that further incorporates a third antigen binding domain that specifically binds a third antigen (e.g., at a trispecific antibody). In other embodiments, the multispecific CD4/CD8 antibodies provided herein may be utilized in a format that further incorporates a fourth antigen binding domain that specifically binds a fourth antigen. (e.g., as a quadraspecific antibody). In some embodiments, the cells comprise CD4-expressing cells. In some embodiments, the cells comprise CD8-expressing cells. In some embodiments, the cells comprise CD4-expressing cells and CD8-expressing cells.

In one aspect, provided herein is a method of enriching CD4-expressing cells and/or CD8-expressing cells comprising: providing a sample comprising the CD4-expressing cells and/or CD8-expressing cells; contacting the sample with a multispecific CD4/CD8 antibody provided herein; and enriching the CD4-expressing cells and/or CD8-expressing cells bound to the multispecific CD4/CD8 antibody. In one aspect, provided herein is a method of isolating CD4-expressing cells and/or CD8-expressing cells comprising: providing a sample comprising the CD4-expressing cells and/or CD8-expressing cells; contacting the sample with a multispecific CD4/CD8 antibody provided herein; and isolating the CD4-expressing cells and/or CD8-expressing cells bound to the multispecific CD4/CD8 antibody. In one aspect, provided herein is a method of separating CD4-expressing cells and/or CD8-expressing cells comprising: providing a sample comprising the CD4-expressing cells and/or CD8-expressing cells; contacting the sample with a multispecific CD4/CD8 antibody provided herein; and separating the CD4-expressing cells and/or CD8-expressing cells bound to the multispecific CD4/CD8 antibody. In one aspect, provided herein is a method of purifying CD4-expressing cells and/or CD8-expressing cells comprising: providing a sample comprising the CD4-expressing cells and/or CD8-expressing cells; contacting the sample with a multispecific CD4/CD8 antibody provided herein; and purifying the CD4-expressing cells and/or CD8-expressing cells bound to the multispecific CD4/CD8 antibody. In one aspect, provided herein is a method of sorting CD4-expressing cells and/or CD8-expressing cells comprising: providing a sample comprising the CD4-expressing cells and/or CD8-expressing cells; contacting the sample with a multispecific CD4/CD8 antibody provided herein; and sorting the CD4-expressing cells and/or CD8-expressing cells bound to the multispecific CD4/CD8 antibody. In one aspect, provided herein is a method of selecting CD4-expressing cells and/or CD8-expressing cells comprising: providing a sample comprising the CD4-expressing cells and/or CD8-expressing cells; contacting the sample with a multispecific CD4/CD8 antibody provided herein; and selecting the CD4-expressing cells and/or CD8-expressing cells bound to the multispecific CD4/CD8 antibody. In one aspect, provided herein is a method of capturing CD4-expressing cells and/or CD8-expressing cells comprising: providing a sample comprising the CD4-expressing cells and/or CD8-expressing cells; contacting the sample with a multispecific CD4/CD8 antibody provided herein; and capturing the CD4-expressing cells and/or CD8-expressing cells bound to the multispecific CD4/CD8 antibody. In one aspect, provided herein is a method of detecting CD4-expressing cells and/or CD8-expressing cells comprising: providing a sample comprising the CD4-expressing cells and/or CD8-expressing cells; contacting the sample with a multispecific CD4/CD8 antibody provided herein; and detecting the CD4-expressing cells and/or CD8-expressing cells bound to the multispecific CD4/CD8 antibody. In some embodiments, the cells comprise CD4-expressing cells. In some embodiments, the cells comprise CD8-expressing cells. In some embodiments, the cells comprise CD4-expressing cells and CD8-expressing cells.

In one aspect, provided herein is a method of enriching CD4-expressing cells and/or CD8-expressing cells comprising: contacting CD4-expressing cells and/or CD8-expressing cells with a multispecific CD4/CD8 antibody provided herein; and enriching the CD4-expressing cells and/or CD8-expressing cells bound to the multispecific CD4/CD8 antibody. In one aspect, provided herein is a method of isolating CD4-expressing cells and/or CD8-expressing cells comprising: contacting CD4-expressing cells and/or CD8-expressing cells with a multispecific CD4/CD8 antibody provided herein; and isolating the CD4-expressing cells and/or CD8-expressing cells bound to the multispecific CD4/CD8 antibody. In one aspect, provided herein is a method of separating CD4-expressing cells and/or CD8-expressing cells comprising: contacting CD4-expressing cells and/or CD8-expressing cells with a multispecific CD4/CD8 antibody provided herein; and separating the CD4-expressing cells and/or CD8-expressing cells bound to the multispecific CD4/CD8 antibody. In one aspect, provided herein is a method of purifying CD4-expressing cells and/or CD8-expressing cells comprising: contacting CD4-expressing cells and/or CD8-expressing cells with a multispecific CD4/CD8 antibody provided herein; and purifying the CD4-expressing cells and/or CD8-expressing cells bound to the multispecific CD4/CD8 antibody. In one aspect, provided herein is a method of sorting CD4-expressing cells and/or CD8-expressing cells comprising: contacting CD4-expressing cells and/or CD8-expressing cells with a multispecific CD4/CD8 antibody provided herein; and sorting the CD4-expressing cells and/or CD8-expressing cells bound to the multispecific CD4/CD8 antibody. In one aspect, provided herein is a method of selecting CD4-expressing cells and/or CD8-expressing cells comprising: contacting CD4-expressing cells and/or CD8-expressing cells with a multispecific CD4/CD8 antibody provided herein; and selecting the CD4-expressing cells and/or CD8-expressing cells bound to the multispecific CD4/CD8 antibody. In one aspect, provided herein is a method of capturing CD4-expressing cells and/or CD8-expressing cells comprising: contacting CD4-expressing cells and/or CD8-expressing cells with a multispecific CD4/CD8 antibody provided herein; and capturing the CD4-expressing cells and/or CD8-expressing cells bound to the multispecific CD4/CD8 antibody. In one aspect, provided herein is a method of detecting CD4-expressing cells and/or CD8-expressing cells comprising: contacting CD4-expressing cells and/or CD8-expressing cells with a multispecific CD4/CD8 antibody provided herein; and detecting the CD4-expressing cells and/or CD8-expressing cells bound to the multispecific CD4/CD8 antibody. In some embodiments, the cells comprise CD4-expressing cells. In some embodiments, the cells comprise CD8-expressing cells. In some embodiments, the cells comprise CD4-expressing cells and CD8-expressing cells.

In one aspect, provided herein is a method of enriching CD4-expressing cells and/or CD8-expressing cells comprising: contacting CD4-expressing cells and/or CD8-expressing cells with a multispecific CD4/CD8 antibody provided herein; and enriching the CD4-expressing cells and/or CD8-expressing cells based on binding of the CD4-expressing cells and/or CD8-expressing cells to the multispecific CD4/CD8 antibody. In one aspect, provided herein is a method of isolating CD4-expressing cells and/or CD8-expressing cells comprising: contacting CD4-expressing cells and/or CD8-expressing cells with a multispecific CD4/CD8 antibody provided herein; and isolating the CD4-expressing cells and/or CD8-expressing cells based on binding of the CD4-expressing cells and/or CD8-expressing cells to the multispecific CD4/CD8 antibody. In one aspect, provided herein is a method of separating CD4-expressing cells and/or CD8-expressing cells comprising: contacting CD4-expressing cells and/or CD8-expressing cells with a multispecific CD4/CD8 antibody provided herein; and separating the CD4-expressing cells and/or CD8-expressing cells based on binding of the CD4-expressing cells and/or CD8-expressing cells to the multispecific CD4/CD8 antibody. In one aspect, provided herein is a method of purifying CD4-expressing cells and/or CD8-expressing cells comprising: contacting CD4-expressing cells and/or CD8-expressing cells with a multispecific CD4/CD8 antibody provided herein; and purifying the CD4-expressing cells and/or CD8-expressing cells based on binding of the CD4-expressing cells and/or CD8-expressing cells to the multispecific CD4/CD8 antibody. In one aspect, provided herein is a method of sorting CD4-expressing cells and/or CD8-expressing cells comprising: contacting CD4-expressing cells and/or CD8-expressing cells with a multispecific CD4/CD8 antibody provided herein; and sorting the CD4-expressing cells and/or CD8-expressing cells based on binding of the CD4-expressing cells and/or CD8-expressing cells to the multispecific CD4/CD8 antibody. In one aspect, provided herein is a method of selecting CD4-expressing cells and/or CD8-expressing cells comprising: contacting CD4-expressing cells and/or CD8-expressing cells with a multispecific CD4/CD8 antibody provided herein; and selecting the CD4-expressing cells and/or CD8-expressing cells based on binding of the CD4-expressing cells and/or CD8-expressing cells to the multispecific CD4/CD8 antibody. In one aspect, provided herein is a method of capturing CD4-expressing cells and/or CD8-expressing cells comprising: contacting CD4-expressing cells and/or CD8-expressing cells with a multispecific CD4/CD8 antibody provided herein; and capturing the CD4-expressing cells and/or CD8-expressing cells based on binding of the CD4-expressing cells and/or CD8-expressing cells to the multispecific CD4/CD8 antibody. In one aspect, provided herein is a method of detecting CD4-expressing cells and/or CD8-expressing cells comprising: contacting CD4-expressing cells and/or CD8-expressing cells with a multispecific CD4/CD8 antibody provided herein; and detecting the CD4-expressing cells and/or CD8-expressing cells based on binding of the CD4-expressing cells and/or CD8-expressing cells to the multispecific CD4/CD8 antibody. In some embodiments, the cells comprise CD4-expressing cells. In some embodiments, the cells comprise CD8-expressing cells. In some embodiments, the cells comprise CD4-expressing cells and CD8-expressing cells.

In some embodiments of the methods, the CD4-expressing cells and/or CD8-expressing cells are in a population of cells. In some embodiments of the methods, the CD4-expressing cells and/or CD8-expressing cells are in a population of lymphocytes. In some embodiments of the methods, the CD4-expressing cells and/or CD8-expressing cells are in a population of T cells. In some embodiments of the methods, the CD4-expressing cells and/or CD8-expressing cells are provided as a population of cells. In some embodiments of the methods, the CD4-expressing cells and/or CD8-expressing cells are provided as a population of lymphocytes. In some embodiments of the methods, the CD4-expressing cells and/or CD8-expressing cells are provided as a population of T cells. In some embodiments of the methods, the CD4-expressing cells and/or CD8-expressing cells are provided as a sample comprising a population of cells. In some embodiments of the methods, the CD4-expressing cells and/or CD8-expressing cells are provided as a sample comprising a population of lymphocytes. In some embodiments of the methods, the CD4-expressing cells and/or CD8-expressing cells are provided as a sample comprising a population of T cells. In some embodiments of the methods, the sample is a blood sample. In some embodiments of the methods, the sample is a tissue sample. In some embodiments of the methods, the sample is a tissue culture sample. In some embodiments, the cells comprise CD4-expressing cells. In some embodiments, the cells comprise CD8-expressing cells. In some embodiments, the cells comprise CD4-expressing cells and CD8-expressing cells.

In some embodiments of the methods, the multispecific CD4/CD8 antibody is a multispecific CD4/CD8 antibody provided herein. In some embodiments of the methods, the multispecific CD4/CD8 antibody is a bispecific CD4/CD8 antibody provided herein. In some embodiments of the methods, the multispecific CD4/CD8 antibody is a trispecific CD4/CD8 antibody provided herein. In some embodiments of the methods, the multispecific CD4/CD8 antibody is a quadraspecific CD4/CD8 antibody provided herein. In certain embodiments, the first binding domain of the multispecific CD4/CD8 antibody that binds CD8 specifically binds to CD8. In certain embodiments, the second binding domain of the multispecific CD4/CD8 antibody that binds CD4 specifically binds to CD4. In one embodiment, the multispecific CD4/CD8 antibody comprises: (a) a first binding domain that binds CD8, and (b) a second binding domain that binds to CD4. In one embodiment, the multispecific CD4/CD8 antibody comprises: (a) a first binding domain that binds CD8, (b) a second binding domain that binds to CD4, and (c) a third binding domain that binds to a third target. In one embodiment, the multispecific CD4/CD8 antibody comprises: (a) a first binding domain that binds CD8, (b) a second binding domain that binds to CD4, (c) a third binding domain that binds to a third target, and (d) a fourth binding domain that binds to a fourth target. In one embodiment, the multispecific CD4/CD8 antibody comprises: (a) a first binding domain that specifically binds CD8, and (b) a second binding domain that specifically binds to CD4. In one embodiment, the multispecific CD4/CD8 antibody comprises: (a) a first binding domain that specifically binds CD8, and (b) a second binding domain that specifically binds to CD4, and (c) a third binding domain that specifically binds to a third target. In one embodiment, the multispecific CD4/CD8 antibody comprises: (a) a first binding domain that specifically binds CD8, and (b) a second binding domain that specifically binds to CD4, (c) a third binding domain that specifically binds to a third target, and (d) a fourth binding domain that specifically binds to a fourth target.

In some embodiments of the methods, the antibody is a multispecific CD4/CD8 antibody, and the third target is not a CD8 antigen. In some embodiments of the methods, the antibody is a multispecific CD4/CD8 antibody, and the fourth target is not a CD8 antigen. In some embodiments of the methods, the antibody is a multispecific CD4/CD8 antibody, and the third target is not a CD8 antigen, and the fourth target is not a CD8 antigen. In some embodiments of the methods, the antibody is a multispecific CD4/CD8 antibody, and the third target is not a CD4 antigen. In some embodiments of the methods, the antibody is a multispecific CD4/CD8 antibody, and the fourth target is not a CD4 antigen. In some embodiments of the methods, the antibody is a multispecific CD4/CD8 antibody, and the third target is not a CD4 antigen, and the fourth target is not a CD4 antigen. In some embodiments of the methods, the antibody is a multispecific CD4/CD8 antibody, and the third target is not a CD8 epitope. In some embodiments of the methods, the antibody is a multispecific CD4/CD8 antibody, and the fourth target is not a CD8 epitope. In some embodiments of the methods, the antibody is a multispecific CD4/CD8 antibody, and the third target is not a CD8 epitope, and the fourth target is not a CD8 epitope. In some embodiments of the methods, the antibody is a multispecific CD4/CD8 antibody, and the third target is not a CD4 epitope. In some embodiments of the methods, the antibody is a multispecific CD4/CD8 antibody, and the fourth target is not a CD4 epitope. In some embodiments of the methods, the antibody is a multispecific CD4/CD8 antibody, and the third target is not a CD4 epitope, and the fourth target is not a CD4 epitope.

In some embodiments of the methods, the antibody is a multispecific CD4/CD8 antibody, and the third target is a TCR complex. In some embodiments of the methods, the antibody is a multispecific CD4/CD8 antibody, and the third target is CD3. In some embodiments of the methods, the antibody is a multispecific CD4/CD8 antibody, and the third target is CD3ε. In some embodiments of the methods, the antibody is a multispecific CD4/CD8 antibody, and the third target is CD3γ. In some embodiments of the methods, the antibody is a multispecific CD4/CD8 antibody, and the third target is CD3δ. In some embodiments of the methods, the antibody is a multispecific CD4/CD8 antibody, and the third target is CD3ζ. In some embodiments of the methods, the antibody is a multispecific CD4/CD8 antibody, and the third target is a TCRα chain. In some embodiments of the methods, the antibody is a multispecific CD4/CD8 antibody, and the third target is a TCRβ chain. In some embodiments of the methods, the antibody is a multispecific CD4/CD8 antibody, and the third target is a TCRγ chain. In some embodiments of the methods, the antibody is a multispecific CD4/CD8 antibody, and the third target is a TCRδ chain. In some embodiments of the methods, the antibody is a multispecific CD4/CD8 antibody, and the third target is a T cell costimulatory molecule. In some embodiments of the methods, the antibody is a multispecific CD4/CD8 antibody, and the third target is CD28. In some embodiments of the methods, the antibody is a multispecific CD4/CD8 antibody, and the third target is CTLA4. In some embodiments of the methods, the antibody is a multispecific CD4/CD8 antibody, and the third target is ICOS. In some embodiments of the methods, the antibody is a multispecific CD4/CD8 antibody, and the third target is 4-1BB. In some embodiments of the methods, the antibody is a multispecific CD4/CD8 antibody, and the third target is GITR. In some embodiments of the methods, the antibody is a multispecific CD4/CD8 antibody, and the third target is CD27. In some embodiments of the methods, the antibody is a multispecific CD4/CD8 antibody, and the third target is OX40. In some embodiments of the methods, the antibody is a multispecific CD4/CD8 antibody, and the third target is CD40L. In some embodiments of the methods, the antibody is a multispecific CD4/CD8 antibody, and the third target is HVEM. In some embodiments of the methods, the antibody is a multispecific CD4/CD8 antibody, and the third target is Galectin-9. In some embodiments of the methods, the antibody is a multispecific CD4/CD8 antibody, and the third target is TIM-1. In some embodiments of the methods, the antibody is a multispecific CD4/CD8 antibody, and the third target is LFA1. In some embodiments of the methods, the antibody is a multispecific CD4/CD8 antibody, and the third target is CD2. In some embodiments of the methods, the antibody is a multispecific CD4/CD8 antibody, and the third target is PD1.

In some embodiments of the methods, the antibody is a multispecific CD4/CD8 antibody, and the fourth target is a TCR complex. In some embodiments of the methods, the antibody is a multispecific CD4/CD8 antibody, and the fourth target is CD3. In some embodiments of the methods, the antibody is a multispecific CD4/CD8 antibody, and the fourth target is CD3ε. In some embodiments of the methods, the antibody is a multispecific CD4/CD8 antibody, and the fourth target is CD3γ. In some embodiments of the methods, the antibody is a multispecific CD4/CD8 antibody, and the fourth target is CD3δ. In some embodiments of the methods, the antibody is a multispecific CD4/CD8 antibody, and the fourth target is CD3ζ. In some embodiments of the methods, the antibody is a multispecific CD4/CD8 antibody, and the fourth target is a TCRα chain. In some embodiments of the methods, the antibody is a multispecific CD4/CD8 antibody, and the fourth target is a TCRβ chain. In some embodiments of the methods, the antibody is a multispecific CD4/CD8 antibody, and the fourth target is a TCRγ chain. In some embodiments of the methods, the antibody is a multispecific CD4/CD8 antibody, and the fourth target is a TCRδ chain. In some embodiments of the methods, the antibody is a multispecific CD4/CD8 antibody, and the fourth target is a T cell costimulatory molecule. In some embodiments of the methods, the antibody is a multispecific CD4/CD8 antibody, and the fourth target is CD28. In some embodiments of the methods, the antibody is a multispecific CD4/CD8 antibody, and the fourth target is CTLA4. In some embodiments of the methods, the antibody is a multispecific CD4/CD8 antibody, and the fourth target is ICOS. In some embodiments of the methods, the antibody is a multispecific CD4/CD8 antibody, and the fourth target is 4-1BB. In some embodiments of the methods, the antibody is a multispecific CD4/CD8 antibody, and the fourth target is GITR. In some embodiments of the methods, the antibody is a multispecific CD4/CD8 antibody, and the fourth target is CD27. In some embodiments of the methods, the antibody is a multispecific CD4/CD8 antibody, and the fourth target is OX40. In some embodiments of the methods, the antibody is a multispecific CD4/CD8 antibody, and the fourth target is CD40L. In some embodiments of the methods, the antibody is a multispecific CD4/CD8 antibody, and the fourth target is HVEM. In some embodiments of the methods, the antibody is a multispecific CD4/CD8 antibody, and the fourth target is Galectin-9. In some embodiments of the methods, the antibody is a multispecific CD4/CD8 antibody, and the fourth target is TIM-1. In some embodiments of the methods, the antibody is a multispecific CD4/CD8 antibody, and the fourth target is LFA1. In some embodiments of the methods, the antibody is a multispecific CD4/CD8 antibody, and the fourth target is CD2. In some embodiments of the methods, the antibody is a multispecific CD4/CD8 antibody, and the fourth target is PD1.

In some embodiments of the methods, the antibody is a multispecific CD4/CD8 antibody, and the third target is a TCR complex, and the fourth target is a T cell costimulatory molecule. In some embodiments of the methods, the antibody is a multispecific CD4/CD8 antibody, and the third target is CD3, and the fourth target is a T cell costimulatory molecule. In some embodiments of the methods, the antibody is a multispecific CD4/CD8 antibody, and the third target is CD3ε, and the fourth target is a T cell costimulatory molecule. In some embodiments of the methods, the antibody is a multispecific CD4/CD8 antibody, and the third target is CD3γ, and the fourth target is a T cell costimulatory molecule. In some embodiments of the methods, the antibody is a multispecific CD4/CD8 antibody, and the third target is CD3δ, and the fourth target is a T cell costimulatory molecule. In some embodiments of the methods, the antibody is a multispecific CD4/CD8 antibody, and the third target is CD3ζ, and the fourth target is a T cell costimulatory molecule. In some embodiments of the methods, the antibody is a multispecific CD4/CD8 antibody, and the third target is a TCRα chain, and the fourth target is a T cell costimulatory molecule. In some embodiments of the methods, the antibody is a multispecific CD4/CD8 antibody, and the third target is a TCRβ chain, and the fourth target is a T cell costimulatory molecule. In some embodiments of the methods, the antibody is a multispecific CD4/CD8 antibody, and the third target is a TCRγ chain, and the fourth target is a T cell costimulatory molecule. In certain embodiments, the T cell costimulatory molecule is CD28. In certain embodiments, the T cell costimulatory molecule is CTLA4. In certain embodiments, the T cell costimulatory molecule is ICOS. In certain embodiments, the T cell costimulatory molecule is 4-1BB. In certain embodiments, the T cell costimulatory molecule is GITR. In certain embodiments, the T cell costimulatory molecule is CD27. In certain embodiments, the T cell costimulatory molecule is OX40. In certain embodiments, the T cell costimulatory molecule is CD40L. In certain embodiments, the T cell costimulatory molecule is HVEM. In certain embodiments, the T cell costimulatory molecule is Galectin-9. In certain embodiments, the T cell costimulatory molecule is TIM-1. In certain embodiments, the T cell costimulatory molecule is LFA1. In certain embodiments, the T cell costimulatory molecule is CD2. In certain embodiments, the T cell costimulatory molecule is PD1.

In a specific embodiment, the target is from a mammal. In a specific embodiment, the target is from a rat. In a specific embodiment, the target is from a mouse. In a specific embodiment, the target is from a primate. In a specific embodiment, the target is from a human.

In specific embodiments of the methods provided herein, the method uses multi-marker detection. In some embodiments, the multi-marker detection uses a multispecific CD4/CD8 antibody provided herein. In some embodiments, the multi-marker detection uses a bispecific CD4/CD8 antibody provided herein. In some embodiments, the multi-marker detection uses a trispecific CD4/CD8 antibody provided herein. In some embodiments, the multi-marker detection uses a quadraspecific CD4/CD8 antibody provided herein.

In certain embodiments of the methods provided herein, the methods are included as steps in a diagnostic method. In certain embodiments of the methods provided herein, the methods are included as steps in a method to quantify the CD4-expressing cells and/or CD8-expressing cells.

In certain embodiments of the methods provided herein, the method further comprises expanding the enriched, isolated, separated, purified, sorted, selected, captured or detected CD4-expressing cells or CD8-expressing cells. In certain embodiments, the expanding is in vitro. In certain embodiments, the expanding is in vivo. In certain embodiments of the methods provided herein, the method further comprises growing the enriched, isolated, separated, purified, sorted, selected, captured or detected CD4-expressing cells or CD8-expressing cells. In certain embodiments, the growing is in vitro. In certain embodiments, the growing is in vivo. In certain embodiments of the methods provided herein, the method further comprises quantifying the enriched, isolated, separated, purified, sorted, selected, captured or detected CD4-expressing cells or CD8-expressing cells.

In some embodiments of the methods provided herein, the method is conducted in suspension. In some embodiments of the methods provided herein, the method is conducted on a solid support.

In some embodiments of the methods provided herein, the method is conducted using beads. In some embodiments of the methods provided herein, the method is conducted using microfluidics. In some embodiments of the methods provided herein, the method is conducted using fluorescent cell sorting. In some embodiments of the methods provided herein, the method is conducted using fluorescence activated cell sorting (FACS). In some embodiments of the methods provided herein, the method is conducted using magnetic bead-based assays (MACS). In some embodiments of the methods provided herein, the method is conducted using a chip. In some embodiments of the methods provided herein, the method is conducted using a column. In some embodiments of the methods provided herein, the method is conducted using a surface. In some embodiments of the methods provided herein, the method is conducted using microfluidics. In some embodiments of the methods provided herein, the method is conducted using microfluidics in combination with a chip. In some embodiments of the methods provided herein, the method is conducted in a single channel. In some embodiments of the methods provided herein, the method is conducted in multiple channels.

In certain embodiments of the methods provided herein, the methods are included as steps in isolating T cells from a patient. In certain embodiments, the patient is a mammal. In specific embodiments, the patient is a human.

EMBODIMENTS

This invention provides the following non-limiting embodiments.

In one set of embodiments, provided are:
1. An antibody that binds CD8, comprising:
   (1) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:31; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:32;
   (2) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:65; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:66;

(3) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:99; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:100;

(4) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:133; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:134;

(5) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:167; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:168;

(6) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:201; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:202;

(7) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:235; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:236;

(8) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:269; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:270;

(9) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:303; and (ii) a VL comprising a VL CDR1, a VL CDR2, and a VL CDR3 having an amino acid sequence of a VL CDR1, a VL CDR2, and a VL CDR3 having an amino acid sequence of a VL CDR1, a VL CDR2, and a VL CDR3, respectively, of a VL having an amino acid sequence of SEQ ID NO:304;

(10) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:337; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:338;

(11) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:371; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:372;

(12) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:405; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:406;

(13) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:439; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:440;

(14) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:473; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:474;

(15) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:507; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:508;

(16) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:541; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:542;

(17) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:575; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:576;

(18) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:609; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:610;

(19) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:643; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:644;

(20) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:677; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:678;

(21) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:711; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:712;

(22) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:745; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:746;

(23) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:779; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:780;

(24) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:813; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:814;

(25) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:847; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:848;

(26) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:881; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:882;

(27) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:915; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:916;

(28) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:949; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:950;

(29) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:983; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:984;

(30) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1017; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1018;

(31) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1051; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1052;

(32) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1085; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1086;

(33) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1119; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1120;

(34) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1153; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1154;

(35) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1187; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1188;

(36) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1221; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1222;

(37) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1255; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1256;

(38) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1289; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1290;

(39) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1323; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1324;

(40) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1357; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1358;

(41) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1391; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1392;

(42) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1425; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1426;

(43) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1459; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1460;

(44) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1493; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1494;

(45) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1527; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1528;

(46) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1561; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1562;
(47) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1595; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1596;
(48) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1629; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1630;
(49) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1663; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1664;
(50) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1697; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1698;
(51) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1731; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1732;
(52) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1765; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1766;
(53) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1799; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1800;
(54) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1833; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1834;
(55) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1867; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1868;
(56) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1901; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1902;
(57) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1935; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1936;
(58) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1969; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1970;
(59) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2003; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2004;
(60) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2037; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2038;
(61) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2071; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2072;

(62) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2105; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2106;

(63) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2139; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2140; or

(64) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2173; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2174.

2. The antibody of embodiment 1, wherein the VH CDR1, VH CDR2, VH CDR3, VL CDR1, VL CDR2, and VL CDR3 amino acid sequences are according to the Kabat numbering system.

3. The antibody of embodiment 1, wherein the VH CDR1, VH CDR2, VH CDR3, VL CDR1, VL CDR2, and VL CDR3 amino acid sequences are according to the Chothia numbering system.

4. The antibody of embodiment 1, wherein the VH CDR1, VH CDR2, VH CDR3, VL CDR1, VL CDR2, and VL CDR3 amino acid sequences are according to the AbM numbering system.

5. The antibody of embodiment 1, wherein the VH CDR1, VH CDR2, VH CDR3, VL CDR1, VL CDR2, and VL CDR3 amino acid sequences are according to the Contact numbering system.

6. The antibody of embodiment 1, wherein the VH CDR1, VH CDR2, VH CDR3, VL CDR1, VL CDR2, and VL CDR3 amino acid sequences are according to the IMGT numbering system.

7. The antibody of any one of embodiments 1 to 6, wherein the antibody is a humanized antibody.

8. The antibody of any one of embodiments 1 to 7, wherein the antibody is an IgG antibody.

9. The antibody of embodiment 8, wherein the IgG antibody is an IgG1, IgG2, IgG3, or IgG4 antibody.

10. The antibody of any one of embodiments 1 to 9, wherein the antibody comprises a kappa light chain.

11. The antibody of any one of embodiments 1 to 9, wherein the antibody comprises a lambda light chain.

12. The antibody of any one of embodiments 1 to 11, wherein the antibody is a monoclonal antibody.

13. The antibody of any one of embodiments 1 to 12, wherein the antibody binds a CD8 antigen.

14. The antibody of any one of embodiments 1 to 12, wherein antibody binds a CD8 epitope.

15. The antibody of any one of embodiments 1 to 14, wherein the antibody specifically binds to CD8.

16. The antibody of any one of embodiments 1 to 15, wherein the VH CDR1, VH CDR2, VH CDR3, VL CDR1, VL CDR2 and VL CDR3 form a binding site for an antigen of the CD8.

17. The antibody of any one of embodiments 1 to 15, wherein the VH CDR1, VH CDR2, VH CDR3, VL CDR1, VL CDR2 and VL CDR3 form a binding site for an epitope of the CD8.

18. The antibody of any one of embodiments 1 to 17, wherein the CD8 is present on the surface of a T cell.

19. An antibody of any one of embodiments 1 to 11, wherein the antibody binds to CD8α.

20. The antibody of embodiment 19, wherein the antibody binds a CD8α antigen.

21. The antibody of embodiment 19, wherein the antibody binds a CD8α epitope.

22. The antibody of any one of embodiments 19 to 21, wherein the antibody specifically binds to CD8.

23. The antibody of any one of embodiments 19 to 22, wherein the VH CDR1, VH CDR2, VH CDR3, VL CDR1, VL CDR2 and VL CDR3 form a binding site for an antigen of the CD8α.

24. The antibody of any one of embodiments 19 to 22, wherein the VH CDR1, VH CDR2, VH CDR3, VL CDR1, VL CDR2 and VL CDR3 form a binding site for an epitope of the CD8α.

25. The antibody of any one of embodiments 19 to 24, wherein the CD8α is present on the surface of a T cell.

26. An antibody of any one of embodiments 1 to 11, wherein the antibody binds to CD8β.

27. The antibody of embodiment 26, wherein the antibody binds a CD8β antigen.

28. The antibody of embodiment 26, wherein the antibody binds a CD8β epitope.

29. The antibody of any one of embodiments 26 to 28, wherein the antibody specifically binds to CD8.

30. The antibody of any one of embodiments 26 to 29, wherein the VH CDR1, VH CDR2, VH CDR3, VL CDR1, VL CDR2 and VL CDR3 form a binding site for an antigen of the CD8β.

31. The antibody of any one of embodiments 26 to 29, wherein the VH CDR1, VH CDR2, VH CDR3, VL CDR1, VL CDR2 and VL CDR3 form a binding site for an epitope of the CD8β.

32. The antibody of any one of embodiments 26 to 29, wherein the CD8β is present on the surface of a T cell.

33. An antibody of any one of embodiments 1 to 11, wherein the antibody binds at the interface of CD8α and CD8β.

34. The antibody of embodiment 33, wherein the antibody binds an antigen at the interface of CD8α and CD8β.

35. The antibody of embodiment 33, wherein the antibody binds an epitope at the interface of CD8α and CD8β.

36. The antibody of any one of embodiments 33 to 35, wherein the antibody specifically binds at the interface of CD8α and CD8β.

37. The antibody of any one of embodiments 33 to 36, wherein the VH CDR1, VH CDR2, VH CDR3, VL CDR1, VL CDR2 and VL CDR3 form a binding site for an antigen at the interface of CD8α and CD8β.

38. The antibody of any one of embodiments 33 to 36, wherein the VH CDR1, VH CDR2, VH CDR3, VL CDR1, VL CDR2 and VL CDR3 form a binding site for an epitope at the interface of CD8α and CD8β.
39. The antibody of any one of embodiments 33 to 38, wherein the interface of CD8α and CD8β is present on the surface of a T cell.
40. The antibody of any one of embodiments 1 to 39, wherein the antibody is multivalent.
41. The antibody of embodiment 40, wherein the antibody is capable of binding at least three antigens.
42. The antibody of embodiment 40, wherein the bispecific antibody is capable of binding at least five antigens.
43. The antibody of any one of embodiments 1 to 42, wherein the antibody is a multispecific antibody.
44. The antibody of embodiment 43, wherein the antibody is a bispecific antibody.
45. The multispecific CD8 antibody of embodiment 43, wherein the multispecific CD8 antibody comprises:
    (i) a first binding domain that binds CD8, and a second binding domain that binds to a second target;
    (ii) a first binding domain that binds CD8, a second binding domain that binds to a second target, and a third binding domain that binds to a third target; or
    (iii) a first binding domain that binds CD8, a second binding domain that binds to a second target, a third binding domain that binds to a third target, and a fourth binding domain that binds to a fourth target.
46. The multispecific CD8 antibody of embodiment 45, wherein the second target is CD4.
47. The multispecific antibody of embodiment 45, wherein the second target is a T cell receptor (TCR) complex, CD3, CD3ε, CD3γ, CD3δ, CD3ζ, a TCRα chain, a TCRβ chain, a TCRγ chain, or a TCRδ chain.
48. The multispecific CD8 antibody of embodiment 45, wherein the second target is a T cell costimulatory molecule, CD28, CTLA4, ICOS, 4-1BB, GITR, CD27, OX40, CD40L, HVEM, Galectin-9, TIM-1, LFA1, CD2, or PD1.
49. The multispecific CD8 antibody of embodiment 45, wherein the second target is CD4; and wherein the third target is a TCR complex, CD3, CD3ε, CD3γ, CD3δ, CD3ζ, a TCRα chain, a TCRβ chain, a TCRγ chain, a TCRδ chain.
50. The multispecific CD8 antibody of embodiment 45, wherein the second target is CD4; and wherein the third target is a T cell costimulatory molecule, CD28, CTLA4, ICOS, 4-1BB, GITR, CD27, OX40, CD40L, HVEM, Galectin-9, TIM-1, LFA1, CD2, or PD1.
51. The multispecific CD8 antibody of embodiment 45, wherein the second target is a TCR complex, CD3, CD3ε, CD3γ, CD3δ, CD3ζ, a TCRα chain, a TCRβ chain, a TCRγ chain, or a TCRδ chain; and wherein the third target is a T cell costimulatory molecule, CD28, CTLA4, ICOS, 4-1BB, GITR, CD27, OX40, CD40L, HVEM, Galectin-9, TIM-1, LFA1, CD2, or PD1.
52. The multispecific CD8 antibody of embodiment 45, wherein the second target is CD4; wherein the third target is a TCR complex, CD3, CD3ε, CD3γ, CD3δ, CD3ζ, a TCRα chain, a TCRβ chain, a TCRγ chain, or a TCRδ chain; and wherein the fourth target is a T cell costimulatory molecule, CD28, CTLA4, ICOS, 4-1BB, GITR, CD27, OX40, CD40L, HVEM, Galectin-9, TIM-1, LFA1, CD2, or PD1.
53. The multispecific CD8 antibody of embodiment 43, wherein the multispecific CD8 antibody comprises: a first binding domain that binds CD8, and a second binding domain that binds to a second target, a third binding domain that binds to a third target, and a fourth binding domain that binds to a fourth target.
54. The multispecific CD8 antibody of embodiment 53, wherein the second target is CD4, the third target is a TCR complex, and the fourth target is a T cell costimulatory molecule.
55. The multispecific antibody of embodiment 54, wherein the third target is CD3.
56. The multispecific antibody of embodiment 54, wherein the third target is CD3ε.
57. The multispecific antibody of embodiment 54, wherein the third target is CD3γ.
58. The multispecific antibody of embodiment 54, wherein the third target is CD3δ.
59. The multispecific antibody of embodiment 54, wherein the third target is CD3ζ.
60. The multispecific antibody of embodiment 54, wherein the third target is a TCRα chain.
61. The multispecific antibody of embodiment 54, wherein the third target is a TCRβ chain.
62. The multispecific antibody of embodiment 54, wherein the third target is a TCRγ chain.
63. The multispecific antibody of embodiment 54, wherein the third target is a TCRδ chain.
64. The multispecific antibody of any one of embodiments 54 to 63, wherein the fourth target is CD28.
65. The multispecific antibody of any one of embodiments 54 to 63, wherein the fourth target is CTLA4.
66. The multispecific antibody of any one of embodiments 54 to 63, wherein the fourth target is ICOS.
67. The multispecific antibody of any one of embodiments 54 to 63, wherein the fourth target is 4-1BB.
68. The multispecific antibody of any one of embodiments 54 to 63, wherein the fourth target is GITR.
69. The multispecific antibody of any one of embodiments 54 to 63, wherein the fourth target is CD27.
70. The multispecific antibody of any one of embodiments 54 to 63, wherein the fourth target is OX40.
71. The multispecific antibody of any one of embodiments 54 to 63, wherein the fourth target is CD40L.
72. The multispecific antibody of any one of embodiments 54 to 63, wherein the fourth target is HVEM.
73. The multispecific antibody of any one of embodiments 54 to 63, wherein the fourth target is Galectin-9.
74. The multispecific antibody of any one of embodiments 54 to 63, wherein the fourth target is TIM-1.
75. The multispecific antibody of any one of embodiments 54 to 63, wherein the fourth target is LFA1.
76. The multispecific antibody of any one of embodiments 54 to 63, wherein the fourth target is CD2.
77. The multispecific antibody of any one of embodiments 54 to 63, wherein the fourth target is PD1.
78. The multispecific CD8 antibody of embodiment 43, wherein the multispecific CD8 antibody comprises: a first binding domain that binds CD8, and a second binding domain that binds to CD4.
79. The multispecific antibody of embodiment 43, wherein the multispecific CD8 antibody comprises a first binding domain that binds CD8, a second binding domain that binds to a second target, and a third binding domain that binds to a third target.
80. The multispecific CD8 antibody of embodiment 79, wherein the second target is a TCR complex, and the third target is a T cell costimulatory molecule.
81. The multispecific antibody of embodiment 80, wherein the second target is CD3.

82. The multispecific antibody of embodiment 80, wherein the second target is CD3ε.
83. The multispecific antibody of embodiment 80, wherein the second target is CD3γ.
84. The multispecific antibody of embodiment 80, wherein the second target is CD3δ.
85. The multispecific antibody of embodiment 80, wherein the second target is CD3ζ.
86. The multispecific antibody of embodiment 80, wherein the second target is a TCRα chain.
87. The multispecific antibody of embodiment 80, wherein the second target is a TCRβ chain.
88. The multispecific antibody of embodiment 80, wherein the second target is a TCRγ chain.
89. The multispecific antibody of embodiment 80, wherein the second target is a TCRδ chain.
90. The multispecific antibody of any one of embodiments 80 to 89, wherein the third target is CD28.
91. The multispecific antibody of any one of embodiments 80 to 89, wherein the third target is CTLA4.
92. The multispecific antibody of any one of embodiments 80 to 89, wherein the third target is ICOS.
93. The multispecific antibody of any one of embodiments 80 to 89, wherein the third target is 4-1BB.
94. The multispecific antibody of any one of embodiments 80 to 89, wherein the third target is GITR.
95. The multispecific antibody of any one of embodiments 80 to 89, wherein the third target is CD27.
96. The multispecific antibody of any one of embodiments 80 to 89, wherein the third target is OX40.
97. The multispecific antibody of any one of embodiments 80 to 89, wherein the third target is CD40L.
98. The multispecific antibody of any one of embodiments 80 to 89, wherein the third target is HVEM.
99. The multispecific antibody of any one of embodiments 80 to 89, wherein the third target is Galectin-9.
100. The multispecific antibody of any one of embodiments 80 to 89, wherein the third target is TIM-1.
101. The multispecific antibody of any one of embodiments 80 to 89, wherein the third target is LFA1.
102. The multispecific antibody of any one of embodiments 80 to 89, wherein the third target is CD2.
103. The multispecific antibody of any one of embodiments 80 to 89, wherein the third target is PD1.
104. A nucleic acid encoding the antibody of any one of embodiments 1 to 103.
105. A vector comprising the nucleic acid of embodiment 104.
106. A host cell comprising the vector of embodiment 105.
107. A kit comprising the vector of embodiment 105 and packaging for the same.
108. A kit comprising the antibody of any one of embodiments 1 to 103 and packaging for the same.
109. A pharmaceutical composition comprising the antibody of any one of embodiments 1 to 103, and a pharmaceutically acceptable carrier.
110. A method of producing the pharmaceutical composition of embodiment 109, comprising combining the antibody with a pharmaceutically acceptable carrier to obtain the pharmaceutical composition.
111. A method of activating a T cell expressing CD8, comprising contacting the T cell with the antibody of any one of embodiments 1 to 103.
112. The method of embodiment 111, wherein the contacting results in an increase in CD69, CD25, and/or Granzyme B expression, as compared to a control T cell expressing CD8.
113. A method of enriching, isolating, separating, purifying, sorting, selecting, capturing or detecting a CD8-expressing cell comprising: providing a sample comprising the CD8-expressing cell; contacting the sample with the CD8 antibody of any one of embodiments 1 to 103; and enriching, isolating, separating, purifying, sorting, selecting, capturing or detecting the CD8-expressing cell bound to the CD8 antibody.
114. A method of enriching, isolating, separating, purifying, sorting, selecting, capturing or detecting a CD8-expressing cell comprising: contacting a CD8-expressing cell with the CD8 antibody of any one of embodiments 1 to 103; and enriching, isolating, separating, purifying, sorting, selecting, capturing or detecting the CD8-expressing cell bound to the CD8 antibody.
115. A method of enriching, isolating, separating, purifying, sorting, selecting, capturing or detecting a CD8-expressing cell comprising: contacting a CD8-expressing cell with the CD8 antibody of any one of embodiments 1 to 103; and enriching, isolating, separating, purifying, sorting, selecting, capturing or detecting the CD8-expressing cell based on binding of the CD8-expressing cell to the CD8 antibody.
116. The method of any one of embodiments 113 to 115, wherein the CD8-expressing cell is a T cell.
117. The method of any one of embodiments 113 to 116, wherein the CD8-expressing cell is a CD8+ cytotoxic T lymphocyte (CTL).
118. The method of any one of embodiments 113 to 117, wherein the CD8-expressing cell is provided as a sample comprising a population of cells.
119. The method of embodiment 118, wherein the cells are lymphocytes.
120. The method of embodiment 118, wherein the cells are T cells.
121. The method of any one of embodiments 118 to 120, wherein the sample is a blood sample.
122. The method of any one of embodiments 118 to 120, wherein the sample is a tissue sample.
123. An antibody that binds CD4, comprising:
(1) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2207; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2208;
(2) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2241; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2242;
(3) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2275; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2276;

(4) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2309; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2310;

(5) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2343; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2344;

(6) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2377; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2378;

(7) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2411; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2412;

(8) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2445; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2446;

(9) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2479; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2480;

(10) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2513; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2514;

(11) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2547; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2548;

(12) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2581; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2582;

(13) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2615; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2616;

(14) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2649; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2650;

(15) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2683; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2684;

(16) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2717; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2718;

(17) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2751; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2752;

(18) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2785; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2786;

(19) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2819; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2820;

(20) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2853; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2854;

(21) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2887; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2888;

(22) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2921; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2922;

(23) i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2955; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2956;

(24) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2989; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2990;

(25) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3023; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3024;

(26) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3057; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3058;

(27) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3091; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3092;

(28) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3125; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3126;

(29) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3159; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3160;

(30) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3193; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3194;

(31) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3227; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3228;

(32) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3261; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3262;

(33) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3295; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3296;

(34) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3329; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3330;

(35) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3363; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3364;

(36) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3397; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3398;

(37) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3431; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3432;

(38) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3465; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3466;

(39) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3499; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3500;

(40) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3533; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3534;

(41) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3567; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3568;

(42) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3601; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3602;

(43) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3635; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3636;

(44) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3669; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3670;

(45) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3703; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3704;

(46) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3737; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3738;

(47) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3771; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3772;

(48) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3805; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3806;

(49) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3839; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3840;

(50) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3873; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3874;

(51) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3907; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3908;

(52) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3941; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3942;

(53) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3975; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3976;

(54) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4009; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4010;

(55) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4043; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4044;

(56) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4077; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4078; or

(57) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4111; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4112.

(58) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4145; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4146;

(59) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4179; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4180;

(60) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4213; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4214;

(61) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4247; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4248;

(62) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4281; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4282;
(63) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4315; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4316;
(64) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4349; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4350;
(65) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4383; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4384;
(66) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4417; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4418;
(67) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4451; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4452;
(68) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4485; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4486;
(69) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4519; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4520;
(70) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4553; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4554;
(71) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4587; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4588;
(72) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4621; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4622;
(73) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4655; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4656;
(74) (i) a VH comprising a VH CDR1, a VH CDR2, and a VH CDR3 having an amino acid sequence of a VH CDR1, a VH CDR2, and a VH CDR3, respectively, of SEQ ID NO:4689; and (ii) a VL comprising a VL CDR1, a VL CDR2, and a VL CDR3 having an amino acid sequence of a VL CDR1, a VL CDR2, and a VL CDR3, respectively, of SEQ ID NO:4690;
(75) (i) a VH comprising a VH CDR1, a VH CDR2, and a VH CDR3 having an amino acid sequence of a VH CDR1, a VH CDR2, and a VH CDR3, respectively, of SEQ ID NO:4723; and (ii) a VL comprising a VL CDR1, a VL CDR2, and a VL CDR3 having an amino acid sequence of a VL CDR1, a VL CDR2, and a VL CDR3, respectively, of SEQ ID NO:4724;
(76) (i) a VH comprising a VH CDR1, a VH CDR2, and a VH CDR3 having an amino acid sequence of a VH CDR1, a VH CDR2, and a VH CDR3, respectively, of SEQ ID NO:4757; and (ii) a VL comprising a VL CDR1, a VL CDR2, and a VL CDR3 having an amino acid sequence of a VL CDR1, a VL CDR2, and a VL CDR3, respectively, of SEQ ID NO:4758;
(77) (i) a VH comprising a VH CDR1, a VH CDR2, and a VH CDR3 having an amino acid sequence of a VH CDR1, a VH CDR2, and a VH CDR3, respectively, of SEQ ID NO:4791; and (ii) a VL comprising a VL CDR1, a VL CDR2, and a VL CDR3 having an amino acid sequence of a VL CDR1, a VL CDR2, and a VL CDR3, respectively, of SEQ ID NO:4792;
(78) (i) a VH comprising a VH CDR1, a VH CDR2, and a VH CDR3 having an amino acid sequence of a VH CDR1, a VH CDR2, and a VH CDR3, respectively, of SEQ ID NO:4825; and (ii) a VL comprising a VL CDR1, a VL CDR2, and a VL CDR3 having an amino acid sequence of a VL CDR1, a VL CDR2, and a VL CDR3, respectively, of SEQ ID NO:4826;

(79) (i) a VH comprising a VH CDR1, a VH CDR2, and a VH CDR3 having an amino acid sequence of a VH CDR1, a VH CDR2, and a VH CDR3, respectively, of SEQ ID NO:4859; and (ii) a VL comprising a VL CDR1, a VL CDR2, and a VL CDR3 having an amino acid sequence of a VL CDR1, a VL CDR2, and a VL CDR3, respectively, of SEQ ID NO:4860;

(80) (i) a VH comprising a VH CDR1, a VH CDR2, and a VH CDR3 having an amino acid sequence of a VH CDR1, a VH CDR2, and a VH CDR3, respectively, of SEQ ID NO:4893; and (ii) a VL comprising a VL CDR1, a VL CDR2, and a VL CDR3 having an amino acid sequence of a VL CDR1, a VL CDR2, and a VL CDR3, respectively, of SEQ ID NO:4894;

(81) (i) a VH comprising a VH CDR1, a VH CDR2, and a VH CDR3 having an amino acid sequence of a VH CDR1, a VH CDR2, and a VH CDR3, respectively, of SEQ ID NO:4927; and (ii) a VL comprising a VL CDR1, a VL CDR2, and a VL CDR3 having an amino acid sequence of a VL CDR1, a VL CDR2, and a VL CDR3, respectively, of SEQ ID NO:4928; or

(82) (i) a VH comprising a VH CDR1, a VH CDR2, and a VH CDR3 having an amino acid sequence of a VH CDR1, a VH CDR2, and a VH CDR3, respectively, of SEQ ID NO:4961; and (ii) a VL comprising a VL CDR1, a VL CDR2, and a VL CDR3 having an amino acid sequence of a VL CDR1, a VL CDR2, and a VL CDR3, respectively, of SEQ ID NO:4962.

124. The antibody of embodiment 123, wherein the VH CDR1, VH CDR2, VH CDR3, VL CDR1, VL CDR2, and VL CDR3 amino acid sequences are according to the Kabat numbering system.

125. The antibody of embodiment 123, wherein the VH CDR1, VH CDR2, VH CDR3, VL CDR1, VL CDR2, and VL CDR3 amino acid sequences are according to the Chothia numbering system.

126. The antibody of embodiment 123, wherein the VH CDR1, VH CDR2, VH CDR3, VL CDR1, VL CDR2, and VL CDR3 amino acid sequences are according to the AbM numbering system.

127. The antibody of embodiment 123, wherein the VH CDR1, VH CDR2, VH CDR3, VL CDR1, VL CDR2, and VL CDR3 amino acid sequences are according to the Contact numbering system.

128. The antibody of embodiment 123, wherein the VH CDR1, VH CDR2, VH CDR3, VL CDR1, VL CDR2, and VL CDR3 amino acid sequences are according to the IMGT numbering system.

129. The antibody of any one of embodiments 123 to 128, wherein the antibody is a humanized antibody.

130. The antibody of any one of embodiments 123 to 129, wherein the antibody is an IgG antibody.

131. The antibody of embodiment 130, wherein the IgG antibody is an IgG1, IgG2, IgG3, or IgG4 antibody.

132. The antibody of any one of embodiments 123 to 131, wherein the antibody comprises a kappa light chain.

133. The antibody of any one of embodiments 123 to 131, wherein the antibody comprises a lambda light chain.

134. The antibody of any one of embodiments 123 to 133, wherein the antibody is a monoclonal antibody.

135. The antibody of any one of embodiments 123 to 134, wherein the antibody binds a CD4 antigen.

136. The antibody of any one of embodiments 123 to 134, wherein antibody binds a CD4 epitope.

137. The antibody of any one of embodiments 123 to 135, wherein the antibody specifically binds to CD4.

138. The antibody of any one of embodiments 123 to 137, wherein the VH CDR1, VH CDR2, VH CDR3, VL CDR1, VL CDR2 and VL CDR3 form a binding site for an antigen of the CD4.

139. The antibody of any one of embodiments 123 to 137, wherein the VH CDR1, VH CDR2, VH CDR3, VL CDR1, VL CDR2 and VL CDR3 form a binding site for an epitope of the CD4.

140. The antibody of any one of embodiments 123 to 139, wherein the CD4 is present on the surface of a T cell.

141. The antibody of any one of embodiments 123 to 140, wherein the antibody is multivalent.

142. The antibody of embodiment 141, wherein the antibody is capable of binding at least three antigens.

143. The antibody of embodiment 141, wherein the bispecific antibody is capable of binding at least five antigens.

144. The antibody of any one of embodiments 123 to 143, wherein the antibody is a multispecific antibody.

145. The antibody of embodiment 144, wherein the antibody is a bispecific antibody.

146. The multispecific CD4 antibody of embodiment 144, wherein the multispecific CD4 antibody comprises:
  (i) a first binding domain that binds CD4, and a second binding domain that binds to a second target;
  (ii) a first binding domain that binds CD4, a second binding domain that binds to a second target, and a third binding domain that binds to a third target; or
  (iii) a first binding domain that binds CD4, and a second binding domain that binds to a second target, a third binding domain that binds to a third target, and a fourth binding domain that binds to a fourth target.

147. The multispecific CD4 antibody of embodiment 141, wherein the second target is CD8.

148. The multispecific antibody of embodiment 146, wherein the second target is a T cell receptor (TCR) complex, CD3, CD3ε, CD3γ, CD3δ, CD3ζ, a TCRα chain, a TCRβ chain, a TCRγ chain, or a TCRδ chain.

149. The multispecific CD4 antibody of embodiment 146, wherein the second target is a T cell costimulatory molecule, CD28, CTLA4, ICOS, 4-1BB, GITR, CD27, OX40, CD40L, HVEM, Galectin-9, TIM-1, LFA1, CD2, or PD1.

150. The multispecific CD4 antibody of embodiment 146, wherein the second target is CD8; and wherein the third target is a TCR complex, CD3, CD3ε, CD3γ, CD3δ, CD3ζ, a TCRα chain, a TCRβ chain, a TCRγ chain, a TCRδ chain.

151. The multispecific CD4 antibody of embodiment 146, wherein the second target is CD8; and wherein the third target is a T cell costimulatory molecule, CD28, CTLA4, ICOS, 4-1BB, GITR, CD27, OX40, CD40L, HVEM, Galectin-9, TIM-1, LFA1, CD2, or PD1.

152. The multispecific CD4 antibody of embodiment 146, wherein the second target is a TCR complex, CD3, CD3ε, CD3γ, CD3δ, CD3ζ, a TCRα chain, a TCRβ chain, a TCRγ chain, or a TCRδ chain; and wherein the third target is a T cell costimulatory molecule, CD28, CTLA4, ICOS, 4-1BB, GITR, CD27, OX40, CD40L, HVEM, Galectin-9, TIM-1, LFA1, CD2, or PD1.

153. The multispecific CD4 antibody of embodiment 146, wherein the second target is CD8; wherein the third target is a TCR complex, CD3, CD3ε, CD3γ, CD3δ, CD3ζ, a TCRα chain, a TCRβ chain, a TCRγ chain, or a TCRδ chain; and wherein the fourth target is a T cell costimulatory molecule, CD28, CTLA4, ICOS, 4-1BB, GITR, CD27, OX40, CD40L, HVEM, Galectin-9, TIM-1, LFA1, CD2, or PD1.

154. The multispecific CD4 antibody of embodiment 144, wherein the multispecific CD4 antibody comprises: a first binding domain that binds CD4, and a second binding domain that binds to a second target, a third binding domain that binds to a third target, and a fourth binding domain that binds to a fourth target.

155. The multispecific CD4 antibody of embodiment 154, wherein the second target is CD8, the third target is a TCR complex, and the fourth target is a T cell costimulatory molecule.

156. The multispecific antibody of embodiment 155, wherein the third target is CD3.

157. The multispecific antibody of embodiment 155, wherein the third target is CD3ε.

158. The multispecific antibody of embodiment 155, wherein the third target is CD3γ.

159. The multispecific antibody of embodiment 155, wherein the third target is CD3δ.

160. The multispecific antibody of embodiment 155, wherein the third target is CD3ζ.

161. The multispecific antibody of embodiment 155, wherein the third target is a TCRα chain.

162. The multispecific antibody of embodiment 155, wherein the third target is a TCRβ chain.

163. The multispecific antibody of embodiment 155, wherein the third target is a TCRγ chain.

164. The multispecific antibody of embodiment 155, wherein the third target is a TCRδ chain.

165. The multispecific antibody of any one of embodiments 155 to 164, wherein the fourth target is CD28.

166. The multispecific antibody of any one of embodiments 155 to 164, wherein the fourth target is CTLA4.

167. The multispecific antibody of any one of embodiments 155 to 164, wherein the fourth target is ICOS.

168. The multispecific antibody of any one of embodiments 155 to 164, wherein the fourth target is 4-1BB.

169. The multispecific antibody of any one of embodiments 155 to 164, wherein the fourth target is GITR.

170. The multispecific antibody of any one of embodiments 155 to 164, wherein the fourth target is CD27.

171. The multispecific antibody of any one of embodiments 155 to 164, wherein the fourth target is OX40.

172. The multispecific antibody of any one of embodiments 155 to 164, wherein the fourth target is CD40L.

173. The multispecific antibody of any one of embodiments 155 to 164, wherein the fourth target is HVEM.

174. The multispecific antibody of any one of embodiments 155 to 164, wherein the fourth target is Galectin-9.

175. The multispecific antibody of any one of embodiments 155 to 164, wherein the fourth target is TIM-1.

176. The multispecific antibody of any one of embodiments 155 to 164, wherein the fourth target is LFA1.

177. The multispecific antibody of any one of embodiments 155 to 164, wherein the fourth target is CD2.

178. The multispecific antibody of any one of embodiments 155 to 164, wherein the fourth target is PD1.

179. The multispecific CD4 antibody of embodiment 144, wherein the multispecific CD4 antibody comprises: a first binding domain that binds CD4, and a second binding domain that binds to CD8.

180. The multispecific antibody of embodiment 144, wherein the multispecific CD4 antibody comprises a first binding domain that binds CD4, a second binding domain that binds to a second target, and a third binding domain that binds to a third target.

181. The multispecific CD4 antibody of embodiment 180, wherein the second target is a TCR complex, and the third target is a T cell costimulatory molecule.

182. The multispecific antibody of embodiment 181, wherein the second target is CD3.

183. The multispecific antibody of embodiment 181, wherein the second target is CD3ε.

184. The multispecific antibody of embodiment 181, wherein the second target is CD3γ.

185. The multispecific antibody of embodiment 181, wherein the second target is CD3δ.

186. The multispecific antibody of embodiment 181, wherein the second target is CD3ζ.

187. The multispecific antibody of embodiment 181, wherein the second target is a TCRα chain.

188. The multispecific antibody of embodiment 181, wherein the second target is a TCRβ chain.

189. The multispecific antibody of embodiment 181, wherein the second target is a TCRγ chain.

190. The multispecific antibody of embodiment 181, wherein the second target is a TCRδ chain.

191. The multispecific antibody of any one of embodiments 181 to 190, wherein the third target is CD28.

192. The multispecific antibody of any one of embodiments 181 to 190, wherein the third target is CTLA4.

193. The multispecific antibody of any one of embodiments 181 to 190, wherein the third target is ICOS.

194. The multispecific antibody of any one of embodiments 181 to 190, wherein the third target is 4-1BB.

195. The multispecific antibody of any one of embodiments 181 to 190, wherein the third target is GITR.

196. The multispecific antibody of any one of embodiments 181 to 190, wherein the third target is CD27.

197. The multispecific antibody of any one of embodiments 181 to 190, wherein the third target is OX40.

198. The multispecific antibody of any one of embodiments 181 to 190, wherein the third target is CD40L.

199. The multispecific antibody of any one of embodiments 181 to 190, wherein the third target is HVEM.

200. The multispecific antibody of any one of embodiments 181 to 190, wherein the third target is Galectin-9.

201. The multispecific antibody of any one of embodiments 181 to 190, wherein the third target is TIM-1.

202. The multispecific antibody of any one of embodiments 181 to 190, wherein the third target is LFA1.

203. The multispecific antibody of any one of embodiments 181 to 190, wherein the third target is CD2.

204. The multispecific antibody of any one of embodiments 181 to 190, wherein the third target is PD1.

205. A nucleic acid encoding the antibody of any one of embodiments 123 to 204.

206. A vector comprising the nucleic acid of embodiment 205.

207. A host cell comprising the vector of embodiment 206.

208. A kit comprising the vector of embodiment 206 and packaging for the same.

209. A kit comprising the antibody of any one of embodiments 123 to 204 and packaging for the same.

210. A pharmaceutical composition comprising the antibody of any one of embodiments 113 to 204, and a pharmaceutically acceptable carrier.

211. A method of producing the pharmaceutical composition of embodiment 210, comprising combining the antibody with a pharmaceutically acceptable carrier to obtain the pharmaceutical composition.
212. A method of activating a T cell expressing CD4, comprising contacting the T cell with the antibody of any one of embodiments 123 to 204.
213. The method of embodiment 212, wherein the contacting results in an increase in CD69, CD25, and/or Granzyme B expression, as compared to a control T cell expressing CD4.
214. A method of enriching, isolating, separating, purifying, sorting, selecting, capturing or detecting a CD4-expressing cell comprising: providing a sample comprising the CD4-expressing cell; contacting the sample with the CD4 antibody of any one of embodiments 123 to 204; and enriching, isolating, separating, purifying, sorting, selecting, capturing or detecting the CD4-expressing cell bound to the CD4 antibody.
215. A method of enriching, isolating, separating, purifying, sorting, selecting, capturing or detecting a CD4-expressing cell comprising: contacting a CD4-expressing cell with the CD4 antibody of any one of embodiments 123 to 204; and enriching, isolating, separating, purifying, sorting, selecting, capturing or detecting the CD4-expressing cell bound to the CD4 antibody.
216. A method of enriching, isolating, separating, purifying, sorting, selecting, capturing or detecting a CD4-expressing cell comprising: contacting a CD4-expressing cell with the CD4 antibody of any one of embodiments 123 to 204; and enriching, isolating, separating, purifying, sorting, selecting, capturing or detecting the CD4-expressing cell based on binding of the CD4-expressing cell to the CD4 antibody.
217. The method of any one of embodiments 214 to 216, wherein the CD4-expressing cell is a T cell.
218. The method of any one of embodiments 214 to 217, wherein the CD4-expressing cell is a CD4+ T helper cell.
219. The method of any one of embodiments 214 to 218, wherein the CD4-expressing cell is provided as a sample comprising a population of cells.
220. The method of embodiment 219, wherein the cells are lymphocytes.
221. The method of embodiment 219, wherein the cells are T cells.
222. The method of any one of embodiments 219 to 221, wherein the sample is a blood sample.
223. The method of any one of embodiments 219 to 221, wherein the sample is a tissue sample.
224. A multispecific antibody, wherein the multispecific antibody comprises: a first binding domain that binds to CD8 and a second binding domain that binds to CD4, wherein
(A) the first binding domain that binds to CD8 comprises:
(1) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:31; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:32;
(2) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:65; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:66;
(3) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:99; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:100;
(4) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:133; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:134;
(5) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:167; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:168;
(6) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:201; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:202;
(7) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:235; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:236;
(8) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:269; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:270;

(9) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:303; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:304;

(10) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:337; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:338;

(11) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:371; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:372;

(12) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:405; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:406;

(13) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:439; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:440;

(14) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:473; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:474;

(15) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:507; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:508;

(16) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:541; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:542;

(17) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:575; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:576;

(18) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:609; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:610;

(19) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:643; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:644;

(20) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:677; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:678;

(21) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:711; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:712;

(22) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:745; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:746;

(23) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:779; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:780;

(24) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:813; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:814;

(25) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:847; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:848;

(26) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:881; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:882;

(27) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:915; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:916;

(28) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:949; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:950;

(29) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:983; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:984;

(30) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1017; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1018;

(31) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1051; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1052;

(32) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1085; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1086;

(33) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1119; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1120;

(34) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1153; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1154;

(35) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1187; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1188;

(36) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1221; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1222;

(37) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1255; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1256;

(38) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1289; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1290;

(39) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1323; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1324;

(40) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1357; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1358;

(41) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1391; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1392;

(42) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1425; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1426;

(43) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1459; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1460;

(44) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1493; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1494;

(45) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1527; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1528;

(46) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1561; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1562;

(47) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1595; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1596;

(48) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1629; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1630;
(49) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1663; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1664;
(50) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1697; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1698;
(51) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1731; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1732;
(52) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1765; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1766;
(53) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1799; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1800;
(54) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1833; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1834;
(55) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1867; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1868;
(56) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1901; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1902;
(57) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1935; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1936;
(58) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1969; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1970;
(59) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2003; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2004;
(60) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2037; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2038;
(61) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2071; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2072;

(62) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2105; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2106;

(63) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2139; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2140; or

(64) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2173; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2174; and (B) the second binding domain that binds to CD4 comprises:

(1) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2207; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2208;

(2) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2241; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2242;

(3) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2275; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2276;

(4) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2309; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2310;

(5) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2343; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2344;

(6) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2377; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2378;

(7) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2411; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2412;

(8) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2445; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2446;

(9) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2479; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2480;

(10) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2513; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2514;

(11) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2547; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2548;

(12) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2581; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2582;

(13) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2615; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2616;

(14) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2649; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2650;

(15) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2683; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2684;

(16) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2717; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2718;

(17) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2751; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2752;

(18) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2785; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2786;

(19) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2819; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2820;

(20) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2853; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2854;

(21) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2887; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2888;

(22) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2921; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2922;

(23) i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2955; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2956;

(24) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2989; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2990;

(25) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3023; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3024;

(26) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3057; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3058;

(27) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3091; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3092;

(28) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3125; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3126;

(29) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3159; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3160;

(30) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3193; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3194;

(31) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3227; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3228;

(32) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3261; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3262;

(33) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3295; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3296;

(34) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3329; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3330;

(35) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3363; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3364;

(36) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3397; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3398;

(37) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3431; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3432;

(38) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3465; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3466;

(39) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3499; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3500;

(40) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3533; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3534;

(41) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3567; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3568;

(42) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3601; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3602;

(43) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3635; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3636;

(44) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3669; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3670;

(45) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3703; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3704;

(46) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3737; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3738;

(47) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3771; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3772;

(48) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3805; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3806;

(49) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3839; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3840;

(50) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3873; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3874;

(51) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3907; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3908;

(52) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3941; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3942;

(53) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3975; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3976;

(54) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4009; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4010;

(55) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4043; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4044;

(56) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4077; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4078; or

(57) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4111; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4112.

(58) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4145; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4146;

(59) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4179; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4180;

(60) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4213; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4214;

(61) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4247; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4248;

(62) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4281; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4282;

(63) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4315; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4316;

(64) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4349; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4350;

(65) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4383; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4384;

(66) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4417; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4418;

(67) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4451; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4452;

(68) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4485; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4486;

(69) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4519; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4520;

(70) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4553; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4554;

(71) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4587; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4588;

(72) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4621; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4622;

(73) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4655; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4656;

(74) (i) a VH comprising a VH CDR1, a VH CDR2, and a VH CDR3 having an amino acid sequence of a VH CDR1, a VH CDR2, and a VH CDR3, respectively, of SEQ ID NO:4689; and (ii) a VL comprising a VL CDR1, a VL CDR2, and a VL CDR3 having an amino acid sequence of a VL CDR1, a VL CDR2, and a VL CDR3, respectively, of SEQ ID NO:4690;

(75) (i) a VH comprising a VH CDR1, a VH CDR2, and a VH CDR3 having an amino acid sequence of a VH CDR1, a VH CDR2, and a VH CDR3, respectively, of SEQ ID NO:4723; and (ii) a VL comprising a VL CDR1, a VL CDR2, and a VL CDR3 having an amino acid sequence of a VL CDR1, a VL CDR2, and a VL CDR3, respectively, of SEQ ID NO:4724;

(76) (i) a VH comprising a VH CDR1, a VH CDR2, and a VH CDR3 having an amino acid sequence of a VH CDR1, a VH CDR2, and a VH CDR3, respectively, of SEQ ID NO:4757; and (ii) a VL comprising a VL CDR1, a VL CDR2, and a VL CDR3 having an amino acid sequence of a VL CDR1, a VL CDR2, and a VL CDR3, respectively, of SEQ ID NO:4758;

(77) (i) a VH comprising a VH CDR1, a VH CDR2, and a VH CDR3 having an amino acid sequence of a VH CDR1, a VH CDR2, and a VH CDR3, respectively, of SEQ ID NO:4791; and (ii) a VL comprising a VL CDR1, a VL CDR2, and a VL CDR3 having an amino acid sequence of a VL CDR1, a VL CDR2, and a VL CDR3, respectively, of SEQ ID NO:4792;

(78) (i) a VH comprising a VH CDR1, a VH CDR2, and a VH CDR3 having an amino acid sequence of a VH CDR1, a VH CDR2, and a VH CDR3, respectively, of SEQ ID NO:4825; and (ii) a VL comprising a VL CDR1, a VL CDR2, and a VL CDR3 having an amino acid sequence of a VL CDR1, a VL CDR2, and a VL CDR3, respectively, of SEQ ID NO:4826;
(79) (i) a VH comprising a VH CDR1, a VH CDR2, and a VH CDR3 having an amino acid sequence of a VH CDR1, a VH CDR2, and a VH CDR3, respectively, of SEQ ID NO:4859; and (ii) a VL comprising a VL CDR1, a VL CDR2, and a VL CDR3 having an amino acid sequence of a VL CDR1, a VL CDR2, and a VL CDR3, respectively, of SEQ ID NO:4860;
(80) (i) a VH comprising a VH CDR1, a VH CDR2, and a VH CDR3 having an amino acid sequence of a VH CDR1, a VH CDR2, and a VH CDR3, respectively, of SEQ ID NO:4893; and (ii) a VL comprising a VL CDR1, a VL CDR2, and a VL CDR3 having an amino acid sequence of a VL CDR1, a VL CDR2, and a VL CDR3, respectively, of SEQ ID NO:4894;
(81) (i) a VH comprising a VH CDR1, a VH CDR2, and a VH CDR3 having an amino acid sequence of a VH CDR1, a VH CDR2, and a VH CDR3, respectively, of SEQ ID NO:4927; and (ii) a VL comprising a VL CDR1, a VL CDR2, and a VL CDR3 having an amino acid sequence of a VL CDR1, a VL CDR2, and a VL CDR3, respectively, of SEQ ID NO:4928; or
(82) (i) a VH comprising a VH CDR1, a VH CDR2, and a VH CDR3 having an amino acid sequence of a VH CDR1, a VH CDR2, and a VH CDR3, respectively, of SEQ ID NO:4961; and (ii) a VL comprising a VL CDR1, a VL CDR2, and a VL CDR3 having an amino acid sequence of a VL CDR1, a VL CDR2, and a VL CDR3, respectively, of SEQ ID NO:4962.

225. The multispecific antibody of embodiment 224, wherein the VH CDR1, VH CDR2, VH CDR3, VL CDR1, VL CDR2, and VL CDR3 amino acid sequences are according to the Kabat numbering system.

226. The multispecific antibody of embodiment 224, wherein the VH CDR1, VH CDR2, VH CDR3, VL CDR1, VL CDR2, and VL CDR3 amino acid sequences are according to the Chothia numbering system.

227. The multispecific antibody of embodiment 224, wherein the VH CDR1, VH CDR2, VH CDR3, VL CDR1, VL CDR2, and VL CDR3 amino acid sequences are according to the AbM numbering system.

228. The multispecific antibody of embodiment 224, wherein the VH CDR1, VH CDR2, VH CDR3, VL CDR1, VL CDR2, and VL CDR3 amino acid sequences are according to the Contact numbering system.

229. The multispecific antibody of embodiment 224, wherein the VH CDR1, VH CDR2, VH CDR3, VL CDR1, VL CDR2, and VL CDR3 amino acid sequences are according to the IMGT numbering system.

230. The multispecific antibody of any one of embodiments 224 to 229, wherein the antibody is a humanized antibody.

231. The multispecific antibody of any one of embodiments 224 to 230, wherein the antibody is an IgG antibody.

232. The multispecific antibody of embodiment 231, wherein the IgG antibody is an IgG1, IgG2, IgG3, or IgG4 antibody.

233. The multispecific antibody of any one of embodiments 224 to 232, wherein the antibody comprises a kappa light chain.

234. The multispecific antibody of any one of embodiments 224 to 232, wherein the antibody comprises a lambda light chain.

235. The multispecific antibody of any one of embodiments 224 to 234, wherein the antibody is a monoclonal antibody.

236. The multispecific antibody of any one of embodiments 224 to 235, wherein the first binding domain binds a CD8 antigen.

237. The multispecific antibody of any one of embodiments 224 to 235, wherein the first binding domain binds a CD8 epitope.

238. The multispecific antibody of any one of embodiments 224 to 237, wherein the first binding domain specifically binds to CD8.

239. The multispecific antibody of any one of embodiments 224 to 238, wherein the VH CDR1, VH CDR2, VH CDR3, VL CDR1, VL CDR2 and VL CDR3 of the first binding domain form a binding site for an antigen of the CD8.

240. The multispecific antibody of any one of embodiments 224 to 238, wherein the VH CDR1, VH CDR2, VH CDR3, VL CDR1, VL CDR2 and VL CDR3 of the first binding domain form a binding site for an epitope of the CD8.

241. The multispecific antibody of any one of embodiments 224 to 240, wherein the CD8 is present on the surface of a T cell.

242. The multispecific antibody of any one of embodiments 224 to 241, wherein the second binding domain binds a CD4 antigen.

243. The multispecific antibody of any one of embodiments 224 to 241, wherein the second binding domain binds a CD4 epitope.

244. The multispecific antibody of any one of embodiments 224 to 243, wherein the second binding domain specifically binds to CD4.

245. The multispecific antibody of any one of embodiments 224 to 244, wherein the VH CDR1, VH CDR2, VH CDR3, VL CDR1, VL CDR2 and VL CDR3 of the second binding domain form a binding site for an antigen of the CD4.

246. The multispecific antibody of any one of embodiments 224 to 244, wherein the VH CDR1, VH CDR2, VH CDR3, VL CDR1, VL CDR2 and VL CDR3 of the second binding domain form a binding site for an epitope of the CD4.

247. The multispecific antibody of any one of embodiments 224 to 246, wherein the CD4 is present on the surface of a T cell.

248. The multispecific antibody of any one of embodiments 224 to 247, wherein the antibody is multivalent.

249. The multispecific antibody of embodiment 248, wherein the antibody is capable of binding at least three antigens.

250. The multispecific antibody of embodiment 248, wherein the antibody is capable of binding at least four antigens.

251. The multispecific antibody of embodiment 248, wherein the antibody is capable of binding at least five antigens.

252. The multispecific antibody of any one of embodiments 224 to 248, wherein the antibody is a bispecific antibody.

253. The multispecific antibody of any one of embodiments 224 to 248, wherein the antibody is a trispecific antibody.

254. The multispecific antibody of any one of embodiments 224 to 248, wherein the antibody is a quadraspecific antibody.
255. The multispecific antibody of any one of embodiments 224 to 248, wherein the multispecific antibody further comprises: a third binding domain that binds to a third target.
256. The multispecific antibody of embodiment 255, wherein the third target is a T Cell Receptor (TCR) complex.
257. The multispecific antibody of embodiment 255, wherein the third target is CD3.
258. The multispecific antibody of embodiment 255, wherein the third target is CD3F.
259. The multispecific antibody of embodiment 255, wherein the third target is CD3γ.
260. The multispecific antibody of embodiment 255, wherein the third target is CD3δ.
261. The multispecific antibody of embodiment 255, wherein the third target is CD3ζ.
262. The multispecific antibody of embodiment 255, wherein the third target is a TCRα chain.
263. The multispecific antibody of embodiment 255, wherein the third target is a TCRβ chain.
264. The multispecific antibody of embodiment 255, wherein the third target is a TCRγ chain.
265. The multispecific antibody of embodiment 255, wherein the third target is a TCRδ chain.
266. The multispecific antibody of any one of embodiments 255 to 265, wherein the multispecific antibody further comprises a fourth binding domain that binds to a fourth target.
267. The multispecific antibody of embodiment 266, wherein the fourth target is CD28.
268. The multispecific antibody of embodiment 266, wherein the fourth target is CTLA4.
269. The multispecific antibody of embodiment 266, wherein the fourth target is ICOS.
270. The multispecific antibody of embodiment 266, wherein the fourth target is 4-1BB.
271. The multispecific antibody of embodiment 266, wherein the fourth target is GITR.
272. The multispecific antibody of embodiment 266, wherein the fourth target is CD27.
273. The multispecific antibody of embodiment 266, wherein the fourth target is OX40.
274. The multispecific antibody of embodiment 266, wherein the fourth target is CD40L.
275. The multispecific antibody of embodiment 266, wherein the fourth target is HVEM.
276. The multispecific antibody of embodiment 266, wherein the fourth target is Galectin-9.
277. The multispecific antibody of embodiment 266, wherein the fourth target is TIM-1.
278. The multispecific antibody of embodiment 266, wherein the fourth target is LFA1.
279. The multispecific antibody of embodiment 266, wherein the fourth target is CD2.
280. The multispecific antibody of embodiment 266, wherein the fourth target is PD1.
281. A nucleic acid encoding the antibody of any one of embodiments 224 to 280.
282. A vector comprising the nucleic acid of embodiment 281.
283. A host cell comprising the vector of embodiment 282.
284. A kit comprising the vector of embodiment 282 and packaging for the same.
285. A kit comprising the antibody of any one of embodiments 224 to 280 and packaging for the same.
286. A pharmaceutical composition comprising the antibody of any one of embodiments 224 to 280, and a pharmaceutically acceptable carrier.
287. A method of producing the pharmaceutical composition of embodiment 286, comprising combining the antibody with a pharmaceutically acceptable carrier to obtain the pharmaceutical composition.
288. A method of enriching, isolating, separating, purifying, sorting, selecting, capturing or detecting CD4-expressing cells and/or CD8-expressing cells comprising: providing a sample comprising the CD4-expressing cells and/or CD8-expressing cells; contacting the sample with the multispecific antibody of any one of embodiments 224 to 280; and enriching, isolating, separating, purifying, sorting, selecting, capturing or detecting the CD4-expressing cells and/or CD8-expressing cells bound to the multispecific antibody.
289. A method of enriching, isolating, separating, purifying, sorting, selecting, capturing or detecting CD4-expressing cells and/or CD8-expressing cells comprising: contacting CD4-expressing cells and/or CD8-expressing cells with the multispecific antibody of any one of embodiments 224 to 280; and enriching, isolating, separating, purifying, sorting, selecting, capturing or detecting the CD4-expressing cells and/or CD8-expressing cells bound to the multispecific antibody.
290. A method of enriching, isolating, separating, purifying, sorting, selecting, capturing or detecting CD4-expressing cells and/or CD8-expressing cells comprising: contacting CD4-expressing cells and/or CD8-expressing cells with the multispecific antibody of any one of embodiments 224 to 280; and enriching, isolating, separating, purifying, sorting, selecting, capturing or detecting the CD4-expressing cells and/or CD8-expressing cells based on binding of the CD4-expressing cells and/or CD8-expressing cells to the multispecific antibody.
291. The method of any one of embodiments 288 to 290, wherein the CD4-expressing cells and/or CD8-expressing cells are T cells.
292. The method of any one of embodiments 288 to 290, wherein the CD4-expressing cells are CD4+ T helper cells.
293. The method of any one of embodiments 288 to 290, wherein the CD8-expressing cells are CD8+ CTL.
294. The method of any one of embodiments 288 to 293, wherein the CD4-expressing cells and/or CD8-expressing cells is provided as a sample comprising a population of cells.
295. The method of embodiment 294, wherein the cells are lymphocytes.
296. The method of embodiment 294, wherein the cells are T cells.
297. The method of any one of embodiments 288 to 296, wherein the sample is a blood sample.
298. The method of any one of embodiments 288 to 296, wherein the sample is a tissue sample.

Provided in the Examples herein are exemplary antibodies that bind to CD8. Exemplary binding agents that bind to CD8 are provided herein, for example in the Examples, as well as Tables 2-7.

In addition, provided in the Examples herein are exemplary antibodies that bind to CD4. Exemplary binding agents that bind to CD4 are provided herein, for example in the Examples, as well as Tables 11-16.

In some embodiments, provided is a multispecific CD4/CD8 antibody comprising a first binding domain that binds to CD8, wherein the first binding domain comprises a VH CDR1, VH CDR2, and VH CDR3 of a CD8 antibody provided in Tables 2-7. In some embodiments, provided is a multispecific CD4/CD8 antibody comprising a first binding domain that binds to CD8, wherein the first binding domain comprises a VL CDR1, VL CDR2, and VL CDR3 of a CD8 antibody provided in Tables 2-7. In some embodiments, provided is a multispecific CD4/CD8 antibody comprising a first binding domain that binds to CD8, wherein the first binding domain comprises a VH CDR1, VH CDR2, VH CDR3, VL CDR1, VL CDR2, and VL CDR3 of a CD8 antibody provided in Tables 2-7. In some embodiments, provided is a multispecific CD4/CD8 antibody comprising a second binding domain that binds to CD4, wherein the second binding domain comprises a VH CDR1, VH CDR2, and VH CDR3 of a CD4 antibody provided in Tables 11-16. In some embodiments, provided is a multispecific CD4/CD4 antibody comprising a second binding domain that binds to CD4, wherein the second binding domain comprises a VL CDR1, VL CDR2, and VL CDR3 of a CD4 antibody provided in Tables 11-16. In some embodiments, provided is a multispecific CD4/CD4 antibody comprising a second binding domain that binds to CD4, wherein the second binding domain comprises a VH CDR1, VH CDR2, VH CDR3, VL CDR1, VL CDR2, and VL CDR3 of a CD4 antibody provided in Tables 11-16.

In some embodiments, provided is a multispecific CD4/CD8 antibody comprising a first binding domain that binds to CD8 and a second binding domain that binds to CD4, wherein the first binding domain that binds to CD8 comprises a VH CDR1, VH CDR2, VH CDR3, VL CDR1, VL CDR2, and VL CDR3 of a CD8 antibody provided in Tables 2-7, and the second binding domain that binds to CD4 comprises a VH CDR1, VH CDR2, VH CDR3, VL CDR1, VL CDR2, and VL CDR3 of a CD4 antibody provided in Tables 11-16. In some embodiments of multispecific CD4/CD8 antibody provided herein, the VH CDR1, VH CDR2, VH CDR3, VL CDR1, VL CDR2, and VL CDR3 amino acid sequences are according to the Kabat numbering system. In some embodiments, the VH CDR1, VH CDR2, VH CDR3, VL CDR1, VL CDR2, and VL CDR3 amino acid sequences are according to the Chothia numbering system. In some embodiments, the VH CDR1, VH CDR2, VH CDR3, VL CDR1, VL CDR2, and VL CDR3 amino acid sequences are according to the AbM numbering system. In some embodiments, the VH CDR1, VH CDR2, VH CDR3, VL CDR1, VL CDR2, and VL CDR3 amino acid sequences are according to the Contact numbering system. In some embodiments, the VH CDR1, VH CDR2, VH CDR3, VL CDR1, VL CDR2, and VL CDR3 amino acid sequences are according to the IMGT numbering system.

Particular embodiments of this invention are described herein. Upon reading the foregoing description, variations of the disclosed embodiments may become apparent to individuals working in the art, and it is expected that those skilled artisans may employ such variations as appropriate. Accordingly, it is intended that the invention be practiced otherwise than as specifically described herein, and that the invention includes all modifications and equivalents of the subject matter recited in the claims appended hereto as permitted by applicable law. Moreover, any combination of the above-described elements in all possible variations thereof is encompassed by the invention unless otherwise indicated herein or otherwise clearly contradicted by context. A number of embodiments of the invention have been described. Nevertheless, it will be understood that various modifications may be made without departing from the spirit and scope of the invention. Accordingly, the descriptions in the Examples section are intended to illustrate but not limit the scope of invention described in the claims.

EXAMPLES

Example 1: Production of Antibodies that Bind CD8

1.1: Generation CD8α Antibodies, CD8β Antibodies, and CD8αβ Antibodies

Immunogen.

Recombinant human CD8alpha/beta heterodimer protein (cat #9358-CD) was obtained from R&D Systems, Inc. The amino acid sequence of the heterodimeric protein is listed in Table 1.

TABLE 1

Amino acid sequence of recombinant human CD8α/β heterodimer protein

| Name | Protein ID | Sequence | SEQ ID NO |
|---|---|---|---|
| Recombinant human CD8α/β heterodimer protein (cat #: 9358-CD) | rhCD8α (Ser22-Asp182) Accession #P01732 | SQFRVSPLDR TWNLGETVEL KCQVLLSNPT SGCSWLFQPR GAAASPTFLL YLSQNKPKAA EGLDTQRFSG KRLGDTFVLT LSDFRRENEG YYFCSALSNS IMYFSHFVPV FLPAKPTTTP APRPPTPAPT IASQPLSLRP EACRPAAGGA VHTRGLDFAC D-[proprietary R&D System acidic tails]-HHHHHH (-HHHHHH Tail SEQ ID NO: 4968) | 4965 |
| | rhCD8β (Asn19-Pro170) Accession #P10966 | NSVLQQTPAY IKVQTNKMVM LSCEAKISLS NMRIYWLRQR QAPSSDSHHE FLALWDSAKG TIHGEEVEQE KIAVFRDASR FILNLTSVKP EDSGIYFCMI VGSPELTFGK GTQLSVVDFL PTTAQPTKKS TLKKRVCRLP RPETQKGPLC SP-[proprietary R&D System basic | 4966 |

TABLE 1-continued

Amino acid sequence of recombinant
human CD8α/β heterodimer protein

| Name | Protein ID | Sequence | SEQ ID NO |
|------|-----------|----------|-----------|
| | | tails]-DYKDDDDK (-DYKDDDDK Tail SEQ ID NO: 4969) | |

Immunization in wild-type mouse and screening of anti-CD8α antibodies, anti-CD8β antibodies, and anti-CD8αβ antibodies. Wild-type (WT) mice with 6 different MHC combinations was immunized using rapid immunization protocol. Eight mice were selected for cell fusion based on serum titer. Hybridoma supernatants were screening by LUMINEX® (immunoassay system) using the immunogen and human pan-T cells. Hits were V-region recovered and formatted into monoclonal IgG1 antibodies.

All the monoclonal antibodies were produced as full-length antibodies as human IgG1. Nucleic acid sequences encoding variable regions were subcloned into a custom mammalian expression vectors containing constant region of IgG1 Fc expression cassettes using standard PCR restriction enzyme based cloning techniques. The mAbs were expressed by transient transfection in Chinese hamster ovary cell line. The antibodies were initially purified by MAB SELECT SURE™ Protein A column (GE healthcare, Piscataway, New Jersey) (Brown, Bottomley et al. 1998). The column was equilibrated with Phosphate Buffer Saline (PBS), pH 7.2 and loaded with fermentation supernatant at a flow rate of 2 mL/min. After loading, the column was washed with PBS (4 CV) followed by elution in 30 mM sodium acetate, pH 3.5. Fractions containing protein peaks as monitored by Absorbance at 280 nm in AKTA™ Explorer (preparative chromatography system) (GE healthcare) were pooled together and were neutralized to pH 5.0 by adding 1% of 3 M sodium acetate, pH 9.0. As a polishing step, the antibodies were purified on a preparative size exclusion chromatography (SEC) using a SUPERDEX® 200 column (GE healthcare). The integrity of the sample was assessed by endotoxin measurement and SDS polyacrylamide gel electrophoresis under reducing and non-reducing conditions. The intact mass was confirmed by mass spectrometry.

The VH and VL sequences of certain CD8 antibodies are provided in Table 2. The CDRs sequences of certain CD8 antibodies are provided in Table 3 (Kabat), Table 4 (Chothia), Table 5 (AbM), Table 6 (Contact), and Table 7 (IMGT). Respective SEQ ID NOs are provided below each sequence.

TABLE 2

| VH and VL Amino Acid Sequences of CD8 Antibodies | | | | | | |
|---|---|---|---|---|---|---|
| # | Protein Name | HC Isotype | LC Isotype | VH AA sequence | VL AA sequence | Heavy Chain AA sequence | Light Chain AA sequence |
| 1 | CD8B191 | IgG1 | Kappa | QIQLVQSGPE LVKPGTSMKM SCKASGYTFT DYYMNWVKQS HGKSLEWIGR VIPSNGGTIY NLKFKGKATL TVDKSLSTAY MQLNSLTSED SAVYFCARED YNNQGFFLDA MDYWGQGTSV TVSS | DIVLTQSPAT LSVTPGDRVS LSCRASQSIS DFLHWYQQKS HESPRLLIKY ASQSISGIPS RFSGSGSGSD FTLTINSVEP EDVGVYYCQN GHSFPYTFGS GTKLEIK | QIQLVQSGPE LVKPGTSMKM SCKASGYTFT DYYMNWVKQS HGKSLEWIGR VIPSNGGTIY NLKFKGKATL TVDKSLSTAY MQLNSLTSED SAVYFCARED YNNQGFFLDA MDYWGQGTSV TVSSASTKGP SVFPLAPSSK STSGGTAALG CLVKDYFPEP VTVSWNSGAL TSGVHTFPAV LQSSGLYSLS SVVTVPSSSL GTQTYICNVN HKPSNTKVDK KVEPKSCDKT HTCPPCPAPE LLGGPSVFLF PPKPKDTLMI SRTPEVTCVV VDVSHEDPEV KFNWYVDGVE VHNAKTKPRE EQYNSTYRVV SVLTVLHQDW LNGKEYKCKV SNKALPAPIE KTISKAKGQP REPQVYTLPP SREEMTKNQV SLTCLVKGFY PSDIAVEWES NGQPENNYKT | DIVLTQSPAT LSVTPGDRVS LSCRASQSIS DFLHWYQQKS HESPRLLIKY ASQSISGIPS RFSGSGSGSD FTLTINSVEP EDVGVYYCQN GHSFPYTFGS GTKLEIKRTV AAPSVFIFPP SDEQLKSGTA SVVCLLNNFY PREAKVQWKV DNALQSGNSQ ESVTEQDSKD STYSLSSTLT LSKADYEKHK VYACEVTHQG LSSPVTKSFN RGEC |

TABLE 2-continued

VH and VL Amino Acid Sequences of CD8 Antibodies

| # | Protein Name | HC Isotype | LC Isotype | VH AA sequence | VL AA sequence | Heavy Chain AA sequence | Light Chain AA sequence |
|---|---|---|---|---|---|---|---|
| | | | | | | TPPVLDSDGS FFLYSKLTVD KSRWQQGNVF SCSVMHEALH NHYTQKSLSL SPGK | |
| | | | | 31 | 32 | 33 | 34 |
| 2 | CD8B226 | IgG1 | Kappa | EFQLQQSGPE LVKPGASVKM SCKASGYTFT DYYMNWVKQS HGKSLQWIGR IIPSNGATIY NQKFKGKATL TVDKSLSLTAY MHLNSLTSED SAVYYCARED YSNQGFFLDA MDYWGQGTTV TVSS | DIVMTQSPAT LSVTPGDRVS LSCRASQSIS HYLHWYQQKL HESPRLLIKY ASQSISGIPS RFSGSGSGSD FTLSINSVEP EDVGVYYCQN GHSFPYTFGG GTKLEIK | EFQLQQSGPE LVKPGASVKM SCKASGYTFT DYYMNWKQSH GKSLQWIGRI IPSNGATIYN QKFKGKATLT VDKSLSTAYM HLNSLTSEDS AVYYCAREDY SNQGFFLDAM DYWGQGTTVT VSSASTKGPS VFPLAPSSKS TSGGTAALGC LVKDYFPEPV TVSWNSGALT SGVHTFPAVL QSSGLYSLSS VVTVPSSSLG TQTYICNVNH KPSNTKVDKK VEPKSCDKTH TCPPCPAPEL LGGPSVFLFP PKPKDTLMIS RTPEVTCVVV DVSHEDPEVK FNWYVDGVEV HNAKTKPREE QYNSTYRVVS VLTVLHQDWL NGKEYKCKVS NKALPAPIEK TISKAKGQPR EPQVYTLPPS REEMTKNQVS LTCLVKGFYP SDIAVEWESN GQPENNYKTT PPVLDSDGSF FLYSKLTVDK SRWQQGNVFS CSVMHEALHN HYTQKSLSLS PGK | DIVMTQSPAT LSVTPGDRVS LSCRASQSIS DYYMNWKQSH HLHWYQQKL HESPRLLIKY ASQSISGIPS RFSGSGSGSD FTLSINSVEP EDVGVYYCQN GHSFPYTFGG GTKLEIKRTV AAPSVFIFPP SDEQLKSGTA SVVCLLNNFY PREAKVQWKV DNALQSGNSQ ESVTEQDSKD STYSLSSTLT LSKADYEKHK VYACEVTHQG LSSPVTKSFN RGEC |
| | | | | 65 | 66 | 67 | 68 |
| 3 | CD8B259 | IgG1 | Kappa | EVQLQQSGPE LVKPGASVKM SCKASGYTFT DYYMNWVKQS HGKSLEWIGR VIPSNGGTIY NQKFRG | DIVMTQSPAT LSVTPGDRVS LSCRASQSIS HFLHWYQQKS HESPRLLIKY ASQSISGSPS | EVQLQQSGPE LVKPGASVKM SCKASGYTFT DYYMNWVKQS HGKSLEWIGR VIPSNGGTIY NQKFRGKATL TVDKSLSTAY MQLNSLTSED SAVYYCARED YGNQGFFLDA MDYWGQGTTV TVSSASTKGP SVFPLAPSSK STSGGTAALG CLVKDYFPEP VTVSWNSGAL TSGVHTFPAV LQSSGLYSLS | DIVMTQSPAT LSVTPGDRVS LSCRASQSIS HFLHWYQQKS HESPRLLIKY ASQSISGSPS KFSGSGSGSD FTLTINSVEP EDVGVYYCQS GHSFPYTFGS GTKLEIKRTV AAPSVFIFPP |

TABLE 2-continued

VH and VL Amino Acid Sequences of CD8 Antibodies

| Protein # | Name | HC Isotype | LC Isotype | VH AA sequence | VL AA sequence | Heavy Chain AA sequence | Light Chain AA sequence |
|---|---|---|---|---|---|---|---|
| | | | | KATLTVDKSL STAYMQLNSL TSEDSAVYYC AREDYGNQGF FLDAMDYWGQ GTTVTVSS | KFSGSGSGSD FTLTINSVEP EDVGVYYCQS GHSFPYTFGS GTKLEIK | SVVTVPSSSL GTQTYICNVN HKPSNTKVDK KVEPKSCDKT HTCPPCPAPE LLGGPSVFLF PPKPKDTLMI SRTPEVTCVV VDVSHEDPEV KFNWYVDGVE VHNAKTKPRE EQYNSTYRVV SVLTVLHQDW LNGKEYKCKV SNKALPAPIE KTISKAKGQP REPQVYTLPP SREEMTKNQV SLTCLVKGFY PSDIAVEWES NGQPENNYKT TPPVLDSDGS FFLYSKLTVD KSRWQQGNVF SCSVMHEALH NHYTQKSLSL SPGK | SDEQLKSGTA SVVCLLNNFY PREAKVQWKV DNALQSGNSQ ESVTEQDSKD STYSLSSTLT LSKADYEKHK VYACEVTHQG LSSPVTKSFN RGEC |
| | | | | 99 | 100 | 101 | 102 |
| 4 | CD8B298 | IgG1 | Kappa | QVQLQQSGPE LVKPGASVKM SCKASGYTFT DYYMNWVKQS HGKSLEWIGR VIPNNGGTRY NQKFKGKATL TVDKSLSTAY MQLNSLTSED SAVYYCARED FSNQGFFLDA MDYWGQGTSV TVSS | DIVMTQSPAT LSVTPGDRVS LSCRASQTIS DYLHWYQQKS HESPRLLIKY ASQSISGIPS RFSGSGSGSD FTLTINSVEP EDVGVYYCQN GHSFPYTFGA GTKLELK | QVQLQQSGPE LVKPGASVKM SCKASGYTFT DYYMNWVKQS HGKSLEWIGR VIPNNGGTRY NQKFKGKATL TVDKSLSTAY MQLNSLTSED SAVYYCARED FSNQGFFLDA MDYWGQGTSV TVSSASTKGP SVFPLAPSSK STSGGTAALG CLVKDYFPEP VTVSWNSGAL TSGVHTFPAV LQSSGLYSLS SVVTVPSSSL GTQTYICNVN HKPSNTKVDK KVEPKSCDKT HTCPPCPAPE LLGGPSVFLF PPKPKDTLMI SRTPEVTCVV VDVSHEDPEV KFNWYVDGVE VHNAKTKPRE EQYNSTYRVV SVLTVLHQDW LNGKEYKCKV SNKALPAPIE KTISKAKGQP REPQVYTLPP SREEMTKNQV SLTCLVKGFY PSDIAVEWES NGQPENNYKT TPPVLDSDGS FFLYSKLTVD KSRWQQGNVF | DIVMTQSPAT LSVTPGDRVS LSCRASQTIS DYLHWYQQKS HESPRLLIKY ASQSISGIPS RFSGSGSGSD FTLTINSVEP EDVGVYYCQN GHSFPYTFGA GTKLELKRTV AAPSVFIFPP SDEQLKSGTA SVVCLLNNFY PREAKVQWKV DNALQSGNSQ ESVTEQDSKD STYSLSSTLT LSKADYEKHK VYACEVTHQG LSSPVTKSFN RGEC |

TABLE 2-continued

VH and VL Amino Acid Sequences of CD8 Antibodies

| Protein # | Name | HC Isotype | LC Isotype | VH AA sequence | VL AA sequence | Heavy Chain AA sequence | Light Chain AA sequence |
|---|---|---|---|---|---|---|---|
| | | | | | | SCSVMHEALH NHYTQKSLSL SPGK | |
| | | | | 133 | 134 | 135 | 136 |
| 5 | CD8B342 | IgG1 | Kappa | EFQLQQSGPE LVKPGASVKV SCKASGYTFT DYYVNWVQQS HGKSLEWIGR VIPNNGNVIY NQNFKGKATL TVDKSLSSAY LQLNSLTSED SAVYYCTRED YSNQGFFLDA MDYWGQGTSV TVSS | DIVMTQTPAT LSVTPGDRVS LSCRASQTIS NYLHWYQQKS HESPRLLIKY ASQSISGIPS RFSGSGSGSD FTLSINSVEP EDVGVYYCQN GHSFPYTFGG GTKLEIK | EFQLQQSGPE LVKPGASVKV SCKASGYTFT DYYVNWVQQS HGKSLEWIGR VIPNNGNVIY NQNFKGKATL TVDKSLSSAY LQLNSLTSED SAVYYCTRED YSNQGFFLDA MDYWGQGTSV TVSSASTKGP SVFPLAPSSK STSGGTAALG CLVKDYFPEP VTVSWNSGAL TSGVHTFPAV LQSSGLYSLS SVVTVPSSSL GTQTYICNVN HKPSNTKVDK KVEPKSCDKT HTCPPCPAPE LLGGPSVFLF PPKPKDTLMI SRTPEVTCVV VDVSHEDPEV KFNWYVDGVE VHNAKTKPRE EQYNSTYRVV SVLTVLHQDW LNGKEYKCKV SNKALPAPIE KTISKAKGQP REPQVYTLPP SREEMTKNQV SLTCLVKGFY PSDIAVEWES NGQPENNYKT TPPVLDSDGS FFLYSKLTVD KSRWQQGNVF SCSVMHEALH NHYTQKSLSL SPGK | DIVMTQTPAT LSVTPGDRVS LSCRASQTIS NYLHWYQQKS HESPRLLIKY ASQSISGIPS RFSGSGSGSD FTLSINSVEP EDVGVYYCQN GHSFPYTFGG GTKLEIKRTV AAPSVFIFPP SDEQLKSGTA SVVCLLNNFY PREAKVQWKV DNALQSGNSQ ESVTEQDSKD STYSLSSTLT LSKADYEKHK VYACEVTHQG LSSPVTKSFN RGEC |
| | | | | 167 | 168 | 169 | 170 |
| 6 | CD8B364 | IgG1 | Kappa | QVQLQQPGAE LVKPGASVKL SCKASGYTFT SYWMHWVNRR PGQGLEWIGE INPSNGDSYY NEKFKRKATL TVDISSSTAY MQLSSLTSED SAVYYCTRSM YDGRAGAYW GQGTTVTSS | DIVLTQSPAS LSVATGEKVT IRCITSTDID DDMNWYQQKP GEPPKLLISE GNTLRPGVPS RFSSSGYGTD FVFTIENTLS EDVADYYCLQ SDNMPLTFGA GTKLELK | QVQLQQPGAE LVKPGASVKL SCKASGYTFT SYWMHWVNRR PGQGLEWIGE INPSNGDSYY NEKFKRKATL TVDISSSTAY MQLSSLTSED SAVYYCTRSM YDGRAGAYW GQGTTVTSS ASTKGPSVFP LAPSSKSTSG GTAALGCLVK DYFPEPVTVS WNSGALTSGV HTFPAVLQSS GLYSLSSVVT VPSSSLGTQT YICNVNHKPS NTKVDKKVEP | DIVLTQSPAS LSVATGEKVT IRCITSTDID DDMNWYQQKP GEPPKLLISE GNTLRPGVPS RFSSSGYGTD FVFTIENTLS EDVADYYCLQ SDNMPLTFGA GTKLELKRTV AAPSVFIFPP SDEQLKSGTA SVVCLLNNFY PREAKVQWKV DNALQSGNSQ ESVTEQDSKD STYSLSSTLT LSKADYEKHK VYACEVTHQG LSSPVTKSFN RGEC |

TABLE 2-continued

VH and VL Amino Acid Sequences of CD8 Antibodies

| Protein # Name | HC Isotype | LC Isotype | VH AA sequence | VL AA sequence | Heavy Chain AA sequence | Light Chain AA sequence |
|---|---|---|---|---|---|---|
| | | | | | KSCDKTHTCP PCPAPELLGG PSVFLFPPKP KDTLMISRTP EVTCVVVDVS HEDPEVKFNW YVDGVEVHNA KTKPREEQYN STYRVVSVLT VLHQDWLNGK EYKCKVSNKA LPAPIEKTIS KAKGQPREPQ VYTLPPSREE MTKNQVSLTC LVKGFYPSDI AVEWESNGQP ENNYKTTPPV LDSDGSFFLY SKLTVDKSRW QQGNVFSCSV MHEALHNHYT QKSLSLSPGK | |
| | | | 201 | 202 | 203 | 204 |
| 7 CD8B200 | IgG1 | Kappa | EVQLQQSGAE LVKPGASVKL SCKASGYTFT NYWIHWVKQR PGQGLEWIGN IDPSDSETHY NQKFKDKATL TVDKSSSTAY MQLISLTSED SAVYYCASGL TGTGYYWGQG TTLTVSS | DIQMTQTTSS LSASLGDRVT ITCRASQDIS PYLNWYQQKP EGTIKLLIYY TSKLHSGVPS RFSGSGSGTD YSLTISNLEQ EDIATYFCQQ DNTLPYTFGS GTKLELK | EVQLQQSGAE LVKPGASVKL SCKASGYTFT NYWIHWVKQR PGQGLEWIGN IDPSDSETHY NQKFKDKATL TVDKSSSTAY MQLISLTSED SAVYYCASGL TGTGYYWGQG TTLTVSSAST KGPSVFPLAP SSKSTSGGTA ALGCLVKDYF PEPVTVSWNS GALTSGVHTF PAVLQSSGLY SLSSVVTVPS SSLGTQTYIC NVNHKPSNTK VDKKVEPKSC DKTHTCPPCP APELLGGPSV FLFPPKPKDT LMISRTPEVT CVVVDVSHED PEVKFNWYVD GVEVHNAKTK PREEQYNSTY RVVSVLTVLH QDWLNGKEYK CKVSNKALPA PIEKTISKAK GQPREPQVYT LPPSREEMTK NQVSLTCLVK GFYPSDIAVE WESNGQPENN YKTTPPVLDS DGSFFLYSKL TVDKSRWQQG NVFSCSVMHE ALHNHYTQKS LSLSPGK | DIQMTQTTSS LSASLGDRVT ITCRASQDIS PYLNWYQQKP EGTIKLLIYY TSKLHSGVPS RFSGSGSGTD YSLTISNLEQ EDIATYFCQQ DNTLPYTFGS GTKLELKRTV AAPSVFIFPP SDEQLKSGTA SVVCLLNNFY PREAKVQWKV DNALQSGNSQ ESVTEQDSKD STYSLSSTLT LSKADYEKHK VYACEVTHQG LSSPVTKSFN RGEC |
| | | | 235 | 236 | 237 | 238 |
| 8 CD8B247 | IgG1 | Kappa | EVQLQQSGPE LVKPGASVKM SCKASGYTFT | DIVMTQSPAT LSVTPGERVS LSCRASQTIS | EVQLQQSGPE LVKPGASVKM SCKASGYTFT | DIVMTQSPAT LSVTPGERVS LSCRASQTIS |

TABLE 2-continued

VH and VL Amino Acid Sequences of CD8 Antibodies

| Protein # | Name | HC Isotype | LC Isotype | VH AA sequence | VL AA sequence | Heavy Chain AA sequence | Light Chain AA sequence |
|---|---|---|---|---|---|---|---|
| | | | | DYYMNWVKQS HGKSLEWIGR VIPNNGGTIY NQKFKDKATL TVDKSLSTAY MQLNSLTSED SAVYYCARED YSNQGFFLDA MDYWGQGTSV TVSS | HFLHWYQQKS HESPRLLIKY ASQSISGIPS RFSGGGSGSD FILTINSVEP EDVGMYYCQS GHSFPYTFGS GTKLEIK | DYYMNWVKQS HGKSLEWIGR VIPNNGGTIY NQKFKDKATL TVDKSLSTAY MQLNSLTSED SAVYYCARED YSNQGFFLDA MDYWGQGTSV TVSSASTKGP SVFPLAPSSK STSGGTAALG CLVKDYFPEP VTVSWNSGAL TSGVHTFPAV LQSSGLYSLS SVVTVPSSSL GTQTYICNVN HKPSNTKVDK KVEPKSCDKT HTCPPCPAPE LLGGPSVFLF PPKPKDTLMI SRTPEVTCVV VDVSHEDPEV KFNWYVDGVE VHNAKTKPRE EQYNSTYRVV SVLTVLHQDW LNGKEYKCKV SNKALPAPIE KTISKAKGQP REPQVYTLPP SREEMTKNQV SLTCLVKGFY PSDIAVEWES NGQPENNYKT TPPVLDSDGS FFLYSKLTVD KSRWQQGNVF SCSVMHEALH NHYTQKSLSL SPGK | HFLHWYQQKS HESPRLLIKY ASQSISGIPS RFSGGGSGSD FILTINSVEP EDVGMYYCQS GHSFPYTFGS GTKLEIKRTV AAPSVFIFPP SDEQLKSGTA SVVCLLNNFY PREAKVQWKV DNALQSGNSQ ESVTEQDSKD STYSLSSTLT LSKADYEKHK VYACEVTHQG LSSPVTKSFN RGEC |
| | | | | 269 | 270 | 271 | 272 |
| 9 | CD8B265 | IgG1 | Kappa | QVQLQQSGPE LVKPGASVKM SCKASGYSFT DYYMNWVKQS HGQSLEWIGR VIPRNGATTY NQNFRGKATL TVDISLRTAY MHLNSLTSDD SAVYYCARED FSNQGFFLDA MDYWGQGTSV TVSS | DIVMTQSPAT LSVTPGDRVS LSCRASQSIS HYLHWYQQKS HESPRLLIKY ASQSISGIPS RFSGSGSGSD FTLSINSVEP EDVGVYYCQN GHSFPYTFGS GTKLEMK | QVQLQQSGPE LVKPGASVKM SCKASGYSFT DYYMNWVKQS HGQSLEWIGR VIPRNGATTY NQNFRGKATL TVDISLRTAY MHLNSLTSDD SAVYYCARED FSNQGFFLDA MDYWGQGTSV TVSSASTKGP SVFPLAPSSK STSGGTAALG CLVKDYFPEP VTVSWNSGAL TSGVHTFPAV LQSSGLYSLS SVVTVPSSSL GTQTYICNVN HKPSNTKVDK KVEPKSCDKT HTCPPCPAPE LLGGPSVFLF PPKPKDTLMI SRTPEVTCVV VDVSHEDPEV KFNWYVDGVE VHNAKTKPRE | DIVMTQSPAT LSVTPGDRVS LSCRASQSIS HYLHWYQQKS HESPRLLIKY ASQSISGIPS RFSGSGSGSD FTLSINSVEP EDVGVYYCQN GHSFPYTFGS GTKLEMKRTV AAPSVFIFPP SDEQLKSGTA SVVCLLNNFY PREAKVQWKV DNALQSGNSQ ESVTEQDSKD STYSLSSTLT LSKADYEKHK VYACEVTHQG LSSPVTKSFN RGEC |

TABLE 2-continued

VH and VL Amino Acid Sequences of CD8 Antibodies

| # | Protein Name | HC Isotype | LC Isotype | VH AA sequence | VL AA sequence | Heavy Chain AA sequence | Light Chain AA sequence |
|---|---|---|---|---|---|---|---|
| | | | | | | EQYNSTYRVV SVLTVLHQDW LNGKEYKCKV SNKALPAPIE KTISKAKGQP REPQVYTLPP SREEMTKNQV SLTCLVKGFY PSDIAVEWES NGQPENNYKT TPPVLDSDGS FFLYSKLTVD KSRWQQGNVF SCSVMHEALH NHYTQKSLSL SPGK | |
| | | | | 303 | 304 | 305 | 306 |
| 10 | CD8B270 | IgG1 | Kappa | QVQLQQPGAE LVKPGASVML SCKASGYTFT NYWMHWVKQR PGQGLEWIGN IDPSDSETHY NQKFKDKATL TVDKSSSTAY MQLSSLTSED SAVYYCASGL TGTGYYWGQG TTLTVSS | DIQMTQTTSS LSASLGDRVT ITCRASQDIR PYLNWYQQKP EGTIKLLIYF TSKLHSGVPS RFSGSGSGTD YSLTISNLEQ EDIATYFCQQ DNTLPYTFGS GTKLELK | QVQLQQPGAE LVKPGASVML SCKASGYTFT NYWMHWVKQR PGQGLEWIGN IDPSDSETHY NQKFKDKATL TVDKSSSTAY MQLSSLTSED SAVYYCASGL TGTGYYWGQG TTLTVSSAST KGPSVFPLAP SSKSTSGGTA ALGCLVKDYF PEPVTVSWNS GALTSGVHTF PAVLQSSGLY SLSSVVTVPS SSLGTQTYIC NVNHKPSNTK VDKKVEPKSC DKTHTCPPCP APELLGGPSV FLFPPKPKDT LMISRTPEVT CVVVDVSHED PEVKFNWYVD GVEVHNAKTK PREEQYNSTY RVVSVLTVLH QDWLNGKEYK CKVSNKALPA PIEKTISKAK GQPREPQVYT LPPSREEMTK NQVSLTCLVK GFYPSDIAVE WESNGQPENN YKTTPPVLDS DGSFFLYSKL TVDKSRWQQG NVFSCSVMHE ALHNHYTQKS LSLSPGK | DIQMTQTTSS LSASLGDRVT ITCRASQDIR PYLNWYQQKP EGTIKLLIYF TSKLHSGVPS RFSGSGSGTD YSLTISNLEQ EDIATYFCQQ DNTLPYTFGS GTKLELKRTV AAPSVFIFPP SDEQLKSGTA SVVCLLNNFY PREAKVQWKV DNALQSGNSQ ESVTEQDSKD STYSLSSTLT LSKADYEKHK VYACEVTHQG LSSPVTKSFN RGEC |
| | | | | 337 | 338 | 339 | 340 |
| 11 | CD8B213 | IgG1 | Kappa | EVQLQQSGPE LVKPGDSMKM SCKASGYIFT DYYMDWVKQS HGKSLEWIGY IYPNNGITSY NQKFKGRATL TIDKSSSTAY MELHSLTSED SAVYYCARSI | DIVLTQSQKF MSTVGDRVS VTCKASQNVD KYVAWYQQKP GQSPKALIYS ASYRYSGVPD RFTGSGSGTD FTLTISNVQS EDLAEYFCQQ YNTYPSFGSG | EVQLQQSGPE LVKPGDSMKM SCKASGYIFT DYYMDWVKQS HGKSLEWIGY IYPNNGITSY NQKFKGRATL TIDKSSSTAY MELHSLTSED SAVYYCARSI | DIVLTQSQKF MSTVGDRVS VTCKASQNVD KYVAWYQQKP GQSPKALIYS ASYRYSGVPD RFTGSGSGTD FTLTISNVQS EDLAEYFCQQ YNTYPSFGSG |

TABLE 2-continued

VH and VL Amino Acid Sequences of CD8 Antibodies

| Protein # | Name | HC Isotype | LC Isotype | VH AA sequence | VL AA sequence | Heavy Chain AA sequence | Light Chain AA sequence |
|---|---|---|---|---|---|---|---|
| | | | | YDHGGGFPY WGQGTSVTVS S | TKLEMK | YYDHGGGFPY WGQGTSVTVS SASTKGPSVF PLAPSSKSTS GGTAALGCLV KDYFPEPVTV SWNSGALTSG VHTFPAVLQS SGLYSLSSVV TVPSSSLGTQ TYICNVNHKP SNTKVDKKVE PKSCDKTHTC PPCPAPELLG GPSVFLFPPK PKDTLMISRT PEVTCVVVDV SHEDPEVKFN WYVDGVEVHN AKTKPREEQY NSTYRVVSVL TVLHQDWLNG KEYKCKVSNK ALPAPIEKTI SKAKGQPREP QVYTLPPSRE EMTKNQVSLT CLVKGFYPSD IAVEWESNGQ PENNYKTTPP VLDSDGSFFL YSKLTVDKSR WQQGNVFSCS VMHEALHNHY TQKSLSLSPG K | TKLEMKRTVA APSVFIFPPS DEQLKSGTAS VVCLLNNFYP REAKVQWKVD NALQSGNSQE SVTEQDSKDS TYSLSSTLTL SKADYEKHKV YACEVTHQGL SSPVTKSFNR GEC |
| | | | | 371 | 372 | 373 | 374 |
| 12 | CD8B240 | IgG1 | Kappa | QVQLQQSGPE LVKPGTSVKM SCKASGYTFT DYYMNWVKQS HGKSLEWIGR VIPSNGGTIY NLKFKGKATL TVDKSLSTAY MQLNSLTSED SAVYFCARED YNNQGFFLDA MDYWGQGTLV TVSA | DIVMTQSPAT LSVTPGDRVS LSCRASQSIS DFLHWYQQKS HESPRLLIKY ASQSISGIPS RFSGSGSGSD FTLTINSVEP EDVGVYYCQN GHSFPYTFGS GTKLEIK | QVQLQQSGPE LVKPGTSVKM SCKASGYTFT DYYMNWVKQS HGKSLEWIGR VIPSNGGTIY NLKFKGKATL TVDKSLSTAY MQLNSLTSED SAVYFCARED YNNQGFFLDA MDYWGQGTLV TVSAASTKGP SVFPLAPSSK STSGGTAALG CLVKDYFPEP VTVSWNSGAL TSGVHTFPAV LQSSGLYSLS SVVTVPSSSL GTQTYICNVN HKPSNTKVDK KVEPKSCDKT HTCPPCPAPE LLGGPSVFLF PPKPKDTLMI SRTPEVTCVV VDVSHEDPEV KFNWYVDGVE VHNAKTKPRE EQYNSTYRVV SVLTVLHQDW LNGKEYKCKV SNKALPAPIE KTISKAKGQP REPQVYTLPP SREEMTKNQV | DIVMTQSPAT LSVTPGDRVS LSCRASQSIS DFLHWYQQKS HESPRLLIKY ASQSISGIPS RFSGSGSGSD FTLTINSVEP EDVGVYYCQN GHSFPYTFGS GTKLEIKRTV AAPSVFIFPP SDEQLKSGTA SVVCLLNNFY PREAKVQWKV DNALQSGNSQ ESVTEQDSKD STYSLSSTLT LSKADYEKHK VYACEVTHQG LSSPVTKSFN RGEC |

TABLE 2-continued

VH and VL Amino Acid Sequences of CD8 Antibodies

| Protein # | Name | HC Isotype | LC Isotype | VH AA sequence | VL AA sequence | Heavy Chain AA sequence | Light Chain AA sequence |
|---|---|---|---|---|---|---|---|
| | | | | | | SLTCLVKGFY PSDIAVEWES NGQPENNYKT TPPVLDSDGS FFLYSKLTVD KSRWQQGNVF SCSVMHEALH NHYTQKSLSL SPGK | |
| | | | | 405 | 406 | 407 | 408 |
| 13 | CD8B36I | IgG1 | Kappa | EVQLQQSGPE LVKPGNSVKM SCKASGYTFT DYYMDWVKQS HGTSLEWIGY IYPNNGDTRY NQKFKDKATL TVDKSSSTAY MELHSLTSED SAVFYCARSI YYDHGGGFPY WGQGTLVTVS A | DIVMTQSQKF MSTSVGDRVS VTCKASQNVG TYVAWYQQKP GQSPKALIYS ASYRYSGVPD RFTGSGSGTD FTLTINNVQS EDLAEYLCQQ YNSYPTFGGG TRLEIK | EVQLQQSGPE LVKPGNSVKM SCKASGYTFT DYYMDWVKQS HGTSLEWIGY IYPNNGDTRY NQKFKDKATL TVDKSSSTAY MELHSLTSED SAVFYCARSI YYDHGGGFPY WGQGTLVTVS AASTKGPSVF PLAPSSKSTS GGTAALGCLV KDYFPEPVTV SWNSGALTSG VHTFPAVLQS SGLYSLSSVV TVPSSSLGTQ TYICNVNHKP SNTKVDKKVE PKSCDKTHTC PPCPAPELLG GPSVFLFPPK PKDTLMISRT PEVTCVVVDV SHEDPEVKFN WYVDGVEVHN AKTKPREEQY NSTYRVVSVL TVLHQDWLNG KEYKCKVSNK ALPAPIEKTI SKAKGQPREP QVYTLPPSRE EMTKNQVSLT CLVKGFYPSD IAVEWESNGQ PENNYKTTPP VLDSDGSFFL YSKLTVDKSR WQQGNVFSCS VMHEALHNHY TQKSLSLSPG K | DIVMTQSQKF MSTSVGDRVS VTCKASQNVG TYVAWYQQKP GQSPKALIYS ASYRYSGVPD RFTGSGSGTD FTLTINNVQS EDLAEYLCQQ YNSYPTFGGG TRLEIKRTVA APSVFIFPPS DEQLKSGTAS VVCLLNNFYP REAKVQWKVD NALQSGNSQE SVTEQDSKDS TYSLSSTLTL SKADYEKHKV YACEVTHQGL SSPVTKSFNR GEC |
| | | | | 439 | 440 | 441 | 442 |
| 14 | CD8B246 | IgG1 | Kappa | QVQLKESGPG ILKPSQTLSL TCSFSGFSLS TSGMNVGWIR QPSGKGLEWL AHIWWDDDKY YNPSLKSQLT ISKDTSRNQV FLKITSVDTA DTATYYCARR GNYGNYEFAY WGQGTTLTVS S | DIQMTQTTSS LSASLGDRVT ISCRASQDIR NYLNWYQQKP DGTVKLLIYH TSRLHSGVPS RFSGSGSGTD YSLTISNLEQ EDIATYFCQQ GNTLPWTFGA GTKLELK | QVQLKESGPG ILKPSQTLSL TCSFSGFSLS TSGMNVGWIR QPSGKGLEWL AHIWWDDDKY YNPSLKSQLT ISKDTSRNQV FLKITSVDTA DTATYYCARR GNYGNYEFAY WGQGTTLTVS SASTKGPSVF PLAPSSKSTS GGTAALGCLV KDYFPEPVTV | DIQMTQTTSS LSASLGDRVT ISCRASQDIR NYLNWYQQKP DGTVKLLIYH TSRLHSGVPS RFSGSGSGTD YSLTISNLEQ EDIATYFCQQ GNTLPWTFGA GTKLELKRTV AAPSVFIFPP SDEQLKSGTA SVVCLLNNFY PREAKVQWKV DNALQSGNSQ |

TABLE 2-continued

VH and VL Amino Acid Sequences of CD8 Antibodies

| Protein # Name | HC Isotype | LC Isotype | VH AA sequence | VL AA sequence | Heavy Chain AA sequence | Light Chain AA sequence |
|---|---|---|---|---|---|---|
| | | | | | SWNSGALTSG VHTFPAVLQS SGLYSLSSVV TVPSSSLGTQ TYICNVNHKP SNTKVDKKVE PKSCDKTHTC PPCPAPELLG GPSVFLFPPK PKDTLMISRT PEVTCVVVDV SHEDPEVKFN WYVDGVEVHN AKTKPREEQY NSTYRVVSVL TVLHQDWLNG KEYKCKVSNK ALPAPIEKTI SKAKGQPREP QVYTLPPSRE EMTKNQVSLT CLVKGFYPSD IAVEWESNGQ PENNYKTTPP VLDSDGSFFL YSKLTVDKSR WQQGNVFSCS VMHEALHNHY TQKSLSLSPG K | ESVTEQDSKD STYSLSSTLT LSKADYEKHK VYACEVTHQG LSSPVTKSFN RGEC |
| | | | 473 | 474 | 475 | 476 |
| 15 CD8B268 | IgG1 | Kappa | QVQLQQSGAE LVKPGASVKL SCKASGYTFT VYTIHWVKQR SGQGLEWIGW FYPGSGNIKY NEKFKDKATL TADKSSHTVY MELSRLTSED SAVYFCARHE DNHYYDGNSW FAYWGQGTLV TVSA | DIQMTQSPAS LSASVGQTVT ITCRASGNIH NYLAWFQQKQ GKSPQLLVYN AKTLADGVPS RFSGSGSGTQ YSLKINSLQT EDFGNYYCQH FWNTPYTFGG GTKLEIK | QVQLQQSGAE LVKPGASVKL SCKASGYTFT VYTIHWVKQR SGQGLEWIGW FYPGSGNIKY NEKFKDKATL TADKSSHTVY MELSRLTSED SAVYFCARHE DNHYYDGNSW FAYWGQGTLV TVSAASTKGP SVFPLAPSSK STSGGTAALG CLVKDYFPEP VTVSWNSGAL TSGVHTFPAV LQSSGLYSLS SVVTVPSSSL GTQTYICNVN HKPSNTKVDK KVEPKSCDKT HTCPPCPAPE LLGGPSVFLF PPKPKDTLMI SRTPEVTCVV VDVSHEDPEV KFNWYVDGVE VHNAKTKPRE EQYNSTYRVV SVLTVLHQDW LNGKEYKCKV SNKALPAPIE KTISKAKGQP REPQVYTLPP SREEMTKNQV SLTCLVKGFY PSDIAVEWES NGQPENNYKT TPPVLDSDGS FFLYSKLTVD KSRWQQGNVF | DIQMTQSPAS LSASVGQTVT ITCRASGNIH NYLAWFQQKQ GKSPQLLVYN AKTLADGVPS RFSGSGSGTQ YSLKINSLQT EDFGNYYCQH FWNTPYTFGG GTKLEIKRTV AAPSVFIFPP SDEQLKSGTA SVVCLLNNFY PREAKVQWKV DNALQSGNSQ ESVTEQDSKD STYSLSSTLT LSKADYEKHK VYACEVTHQG LSSPVTKSFN RGEC |

TABLE 2-continued

VH and VL Amino Acid Sequences of CD8 Antibodies

| # | Protein Name | HC Isotype | LC Isotype | VH AA sequence | VL AA sequence | Heavy Chain AA sequence | Light Chain AA sequence |
|---|---|---|---|---|---|---|---|
| | | | | | | SCSVMHEALH NHYTQKSLSL SPGK | |
| | | | | 507 | 508 | 509 | 510 |
| 16 | CD8B271 | IgG1 | Kappa | DVQLQESGPG LVAPSQSLSI TCTVSGFSLS IYSIHWVRQP PGKGLEWLGM IWGGGDTDYN SALKSRLSIS KDNSESQVFL KMNSLQTDDT AMYYCARNPH YYGGTYEYFD VWGTGTTVTV SS | DIQMTQTTSS LSASLGDRVT ISCSASQGIS NYLNWYQQKP DGTVKLLIYD TSILYSGVPS RFSGSGSGTD YSLTISNLEP EDVATYYCQQ YSNLPYTFGS GTKLEIK | DVQLQESGPG LVAPSQSLSI TCTVSGFSLS IYSIHWVRQP PGKGLEWLGM IWGGGDTDYN SALKSRLSIS KDNSESQVFL KMNSLQTDDT AMYYCARNPH YYGGTYEYFD VWGTGTTVTV SSASTKGPSV FPLAPSSKST SGGTAALGCL VKDYFPEPVT VSWNSGALTS GVHTFPAVLQ SSGLYSLSSV VTVPSSSLGT QTYICNVNHK PSNTKVDKKV EPKSCDKTHT CPPCPAPELL GGPSVFLFPP KPKDTLMISR TPEVTCVVVD VSHEDPEVKF NWYVDGVEVH NAKTKPREEQ YNSTYRVVSV LTVLHQDWLN GKEYKCKVSN KALPAPIEKT ISKAKGQPRE PQVYTLPPSR EEMTKNQVSL TCLVKGFYPS DIAVEWESNG QPENNYKTTP PVLDSDGSFF LYSKLTVDKS RWQQGNVFSC SVMHEALHNH YTQKSLSLSP GK | DIQMTQTTSS LSASLGDRVT ISCSASQGIS NYLNWYQQKP DGTVKLLIYD TSILYSGVPS RFSGSGSGTD YSLTISNLEP EDVATYYCQQ YSNLPYTFGS GTKLEIKRTV AAPSVFIFPP SDEQLKSGTA SVVCLLNNFY PREAKVQWKV DNALQSGNSQ ESVTEQDSKD STYSLSSTLT LSKADYEKHK VYACEVTHQG LSSPVTKSFN RGEC |
| | | | | 541 | 542 | 543 | 544 |
| 17 | CD8B273 | IgG1 | Kappa | QVQLQQSGAE LVKPGASVKL SCKASGYTFT EYTIHWVKQR SGQGLEWIGW FYPGTGSIKY NEKFKDKATL TADKSSHTVY MELSKLTSED SAVYFCARHE DNHYYDGNSW FAYWGQGTLV TVSA | DIQMTQSPAS LSASVGETVT ITCRASGNIH NYLAWFQQKQ GKSPQLLVYN AKTLADGVPS RFSGSGSGTQ YSLKINSLQA EDFGSYYCQH FWSTPYTFGS GTKLEIK | QVQLQQSGAE LVKPGASVKL SCKASGYTFT EYTIHWVKQR SGQGLEWIGW FYPGTGSIKY NEKFKDKATL TADKSSHTVY MELSKLTSED SAVYFCARHE DNHYYDGNSW FAYWGQGTLV TVSAASTKGP SVFPLAPSSK STSGGTAALG CLVKDYFPEP VTVSWNSGAL TSGVHTFPAV LQSSGLYSLS SVVTVPSSSL GTQTYICNVN HKPSNTKVDK | DIQMTQSPAS LSASVGETVT ITCRASGNIH NYLAWFQQKQ GKSPQLLVYN AKTLADGVPS RFSGSGSGTQ YSLKINSLQA EDFGSYYCQH FWSTPYTFGS GTKLEIKRTV AAPSVFIFPP SDEQLKSGTA SVVCLLNNFY PREAKVQWKV DNALQSGNSQ ESVTEQDSKD STYSLSSTLT LSKADYEKHK VYACEVTHQG LSSPVTKSFN RGEC |

TABLE 2-continued

VH and VL Amino Acid Sequences of CD8 Antibodies

| Protein # Name | HC Isotype | LC Isotype | VH AA sequence | VL AA sequence | Heavy Chain AA sequence | Light Chain AA sequence |
|---|---|---|---|---|---|---|
| | | | | | KVEPKSCDKT HTCPPCPAPE LLGGPSVFLF PPKPKDTLMI SRTPEVTCVV VDVSHEDPEV KFNWYVDGVE VHNAKTKPRE EQYNSTYRVV SVLTVLHQDW LNGKEYKCKV SNKALPAPIE KTISKAKGQP REPQVYTLPP SREEMTKNQV SLTCLVKGFY PSDIAVEWES NGQPENNYKT TPPVLDSDGS FFLYSKLTVD KSRWQQGNVF SCSVMHEALH NHYTQKSLSL SPGK | |
| | | | 575 | 576 | 577 | 578 |
| 18 CD8B288 | IgG1 | Kappa | QVQLQQSGAE LVKPGASVKL SCKASGYTFT EYTIHWVKQK SGQGLEWIGW FYPGNGNMRY NEKFKDKATL TADRSSHTVY MELSRLTSED SAVYFCARYE DNHYYDGASW FAYWGQGTSV TVSS | DIQMTQSPAS LSASVGDTVT ITCRASGNIH NYLAWFQQKQ GKSPQLLVYN AKTLADGVPS RFSGSGSGTQ FSLKINSLQP EDFGTYYCQH FWSTPFTFGS GTKLEMK | QVQLQQSGAE LVKPGASVKL SCKASGYTFT EYTIHWVKQK SGQGLEWIGW FYPGNGNMRY NEKFKDKATL TADRSSHTVY MELSRLTSED SAVYFCARYE DNHYYDGASW FAYWGQGTSV TVSSASTKGP SVFPLAPSSK STSGGTAALG CLVKDYFPEP VTVSWNSGAL TSGVHTFPAV LQSSGLYSLS SVVTVPSSSL GTQTYICNVN HKPSNTKVDK KVEPKSCDKT HTCPPCPAPE LLGGPSVFLF PPKPKDTLMI SRTPEVTCVV VDVSHEDPEV KFNWYVDGVE VHNAKTKPRE EQYNSTYRVV SVLTVLHQDW LNGKEYKCKV SNKALPAPIE KTISKAKGQP REPQVYTLPP SREEMTKNQV SLTCLVKGFY PSDIAVEWES NGQPENNYKT TPPVLDSDGS FFLYSKLTVD KSRWQQGNVF SCSVMHEALH NHYTQKSLSL SPGK | DIQMTQSPAS LSASVGDTVT ITCRASGNIH NYLAWFQQKQ GKSPQLLVYN AKTLADGVPS RFSGSGSGTQ FSLKINSLQP EDFGTYYCQH FWSTPFTFGS GTKLEMKRTV AAPSVFIFPP SDEQLKSGTA SVVCLLNNFY PREAKVQWKV DNALQSGNSQ ESVTEQDSKD STYSLSSTLT LSKADYEKHK VYACEVTHQG LSSPVTKSFN RGEC |
| | | | 609 | 610 | 611 | 612 |

TABLE 2-continued

VH and VL Amino Acid Sequences of CD8 Antibodies

| # | Protein Name | HC Isotype | LC Isotype | VH AA sequence | VL AA sequence | Heavy Chain AA sequence | Light Chain AA sequence |
|---|---|---|---|---|---|---|---|
| 19 | CD8B292 | IgG1 | Kappa | QVQLQQPGAE LVKPGASVKL SCTGSGFNFK DDYIYWVKQR PEQGLEWIGW IDPENGATEY ASKFQGKATI TADTSSNIAY LQLSSLTSED TAVYYCSLHD YGYAMDYWGQ GTSVTVSS | QIVLTQSPAI MSASLGERVT LTCTASSSVS SSYLHWYQQK PGSSPKLWIY STSNLASGVP ARFSGSGSGT SYSLTISNME AEDAATYYCH QYHRSPLTFG GGTKLEIK | QVQLQQPGAE LVKPGASVKL SCTGSGFNFK DDYIYWVKQR PEQGLEWIGW IDPENGATEY ASKFQGKATI TADTSSNIAY LQLSSLTSED TAVYYCSLHD YGYAMDYWGQ GTSVTVSSAS TKGPSVFPLA PSSKSTSGGT AALGCLVKDY FPEPVTVSWN SGALTSGVHT FPAVLQSSGL YSLSSVVTVP SSSLGTQTYI CNVNHKPSNT KVDKKVEPKS CDKTHTCPPC PAPELLGGPS VFLFPPKPKD TLMISRTPEV TCVVVDVSHE DPEVKFNWYV DGVEVHNAKT KPREEQYNST YRVVSVLTVL HQDWLNGKEY KCKVSNKALP APIEKTISKA KGQPREPQVY TLPPSREEMT KNQVSLTCLV KGFYPSDIAV EWESNGQPEN NYKTTPPVLD SDGSFFLYSK LTVDKSRWQQ GNVFSCSVMH EALHNHYTQK SLSLSPGK | QIVLTQSPAI MSASLGERVT LTCTASSSVS SSYLHWYQQK PGSSPKLWIY STSNLASGVP ARFSGSGSGT SYSLTISNME AEDAATYYCH QYHRSPLTFG GGTKLEIKRT VAAPSVFIFP PSDEQLKSGT ASVVCLLNNF YPREAKVQWK VDNALQSGNS QESVTEQDSK DSTYSLSSTL TLSKADYEKH KVYACEVTHQ GLSSPVTKSF NRGEC |
|  |  |  |  | 643 | 644 | 645 | 646 |
| 20 | CD8B303 | IgG1 | Kappa | QVQLKESGPG LVAPSQSLSI TCTVSGFSLS IYSIHWVRQP PGKGLEWLGM IWGGGSTDYN STLNSRLSII KDNSKSQVFL KMNSLQTDDT AMYYCARNPH HYGGSTGAMD YWGQGTTVTV SS | DVQMIQSPSS LSASLGGTVT ITCKASQDIK KYMAWYQHKP GKGPRLLIHY TSSLQPGIPS RFSGSGSGRD YYFSISNLEP EDIATYFCLQ YDNLFTFGSG TKLELK | QVQLKESGPG LVAPSQSLSI TCTVSGFSLS IYSIHWVRQP PGKGLEWLGM IWGGGSTDYN STLNSRLSII KDNSKSQVFL KMNSLQTDDT AMYYCARNPH HYGGSTGAMD YWGQGTTVTV SSASTKGPSV FPLAPSSKST SGGTAALGCL VKDYFPEPVT VSWNSGALTS GVHTFPAVLQ SSGLYSLSSV VTVPSSSLGT QTYICNVNHK PSNTKVDKKV EPKSCDKTHT CPPCPAPELL GGPSVFLFPP KPKDTLMISR TPEVTCVVVD | DVQMIQSPSS LSASLGGTVT ITCKASQDIK KYMAWYQHKP GKGPRLLIHY TSSLQPGIPS RFSGSGSGRD YYFSISNLEP EDIATYFCLQ YDNLFTFGSG TKLELKRTVA APSVFIFPPS DEQLKSGTAS VVCLLNNFYP REAKVQWKVD NALQSGNSQE SVTEQDSKDS TYSLSSTLTL SKADYEKHKV YACEVTHQGL SSPVTKSFNR GEC |

TABLE 2-continued

VH and VL Amino Acid Sequences of CD8 Antibodies

| # | Protein Name | HC Isotype | LC Isotype | VH AA sequence | VL AA sequence | Heavy Chain AA sequence | Light Chain AA sequence |
|---|---|---|---|---|---|---|---|
| | | | | | | VSHEDPEVKF NWYVDGVEVH NAKTKPREEQ YNSTYRVVSV LTVLHQDWLN GKEYKCKVSN KALPAPIEKT ISKAKGQPRE PQVYTLPPSR EEMTKNQVSL TCLVKGFYPS DIAVEWESNG QPENNYKTTP PVLDSDGSFF LYSKLTVDKS RWQQGNVFSC SVMHEALHNH YTQKSLSLSP GK | |
| | | | | 677 | 678 | 679 | 680 |
| 21 | CD8B304 | IgG1 | Kappa | QVTLKESGPG ILKPSQTLSL TCSFSGFSLS TSGMNVGWIR QPSGKGLEWL AHIWWDDDKY YNPSLKSQLT ISKDTSRNQV FLKITSVDTA DTATYYCARR GNYGNYEFAY WGQGTTVTVS S | DIQMTQTTSS LSASLGDRVT ISCRASQDIR NYLNWYQQKP DGTVKLLIYH TSRLHSGVPS RFSGSGSGTD YSLTISNLDQ EDIATYFCQQ GNTLPWTFGA GTKLELK | QVTLKESGPG ILKPSQTLSL TCSFSGFSLS TSGMNVGWIR QPSGKGLEWL AHIWWDDDKY YNPSLKSQLT ISKDTSRNQV FLKITSVDTA DTATYYCARR GNYGNYEFAY WGQGTTVTVS SASTKGPSVF PLAPSSKSTS GGTAALGCLV KDYFPEPVTV SWNSGALTSG VHTFPAVLQS SGLYSLSSVV TVPSSSLGTQ TYICNVNHKP SNTKVDKKVE PKSCDKTHTC PPCPAPELLG GPSVFLFPPK PKDTLMISRT PEVTCVVVDV SHEDPEVKFN WYVDGVEVHN AKTKPREEQY NSTYRVVSVL TVLHQDWLNG KEYKCKVSNK ALPAPIEKTI SKAKGQPREP QVYTLPPSRE EMTKNQVSLT CLVKGFYPSD IAVEWESNGQ PENNYKTTPP VLDSDGSFFL YSKLTVDKSR WQQGNVFSCS VMHEALHNHY TQKSLSLSPG K | DIQMTQTTSS LSASLGDRVT ISCRASQDIR NYLNWYQQKP DGTVKLLIYH TSRLHSGVPS RFSGSGSGTD YSLTISNLDQ EDIATYFCQQ GNTLPWTFGA GTKLELKRTV AAPSVFIFPP SDEQLKSGTA SVVCLLNNFY PREAKVQWKV DNALQSGNSQ ESVTEQDSKD STYSLSSTLT LSKADYEKHK VYACEVTHQG LSSPVTKSFN RGEC |
| | | | | 711 | 712 | 713 | 714 |
| 22 | CD8B312 | IgG1 | Kappa | QVQLQQPGAD LVKPGASVKL SCKASGYTFT SFWMHWVKQR PGQGLEWIGN VDPSDSQTHY | DIVLTQSPAT LSVTPGDSVS LSCRASQSIN NNLHWYQQKS HESPRLLIKY TSQSISGIPS | QVQLQQPGAD LVKPGASVKL SCKASGYTFT SFWMHWVKQR PGQGLEWIGN VDPSDSQTHY | DIVLTQSPAT LSVTPGDSVS LSCRASQSIN NNLHWYQQKS HESPRLLIKY TSQSISGIPS |

TABLE 2-continued

VH and VL Amino Acid Sequences of CD8 Antibodies

| # | Protein Name | HC Isotype | LC Isotype | VH AA sequence | VL AA sequence | Heavy Chain AA sequence | Light Chain AA sequence |
|---|---|---|---|---|---|---|---|
| | | | | NQKFKDKATL TVDKSSNTAY MQLSSLTSED SAVYYCARST YYRYDGPFTY WGQGTTVTVS S | RFSGSGSGPD FTLSINSVET EDFGMYFCQQ SNSWPLTFGG GTKLEIK | NQKFKDKATL TVDKSSNTAY MQLSSLTSED SAVYYCARST YYRYDGPFTY WGQGTTVTVS SASTKGPSVF PLAPSSKSTS GGTAALGCLV KDYFPEPVTV SWNSGALTSG VHTFPAVLQS SGLYSLSSVV TVPSSSLGTQ TYICNVNHKP SNTKVDKKVE PKSCDKTHTC PPCPAPELLG GPSVFLFPPK PKDTLMISRT PEVTCVVVDV SHEDPEVKFN WYVDGVEVHN AKTKPREEQY NSTYRVVSVL TVLHQDWLNG KEYKCKVSNK ALPAPIEKTI SKAKGQPREP QVYTLPPSRE EMTKNQVSLT CLVKGFYPSD IAVEWESNGQ PENNYKTTPP VLDSDGSFFL YSKLTVDKSR WQQGNVFSCS VMHEALHNHY TQKSLSLSPG K | RFSGSGSGPD FTLSINSVET EDFGMYFCQQ SNSWPLTFGG GTKLEIKRTV AAPSVFIFPP SDEQLKSGTA SVVCLLNNFY PREAKVQWKV DNALQSGNSQ ESVTEQDSKD STYSLSSTLT LSKADYEKHK VYACEVTHQG LSSPVTKSFN RGEC |
| | | | | 745 | 746 | 747 | 748 |
| 23 | CD8B347 | IgG1 | Kappa | QVQLQQPGAE LAKPGTSVKM SCKASGYTFT SYWMNWIKQR PGQGLEWIGA VNPSNSYTEY AQKFKDKAIL TADKSSSTAY MSLSGLTSEA SAVYYCARSG LYNTNHLAWF AYWGQGTLVT VSA | DIQMTQSPAS LSASVGETVT ITCRASGNIH NYLAWYQQKQ GKSPQLLVFN AETLADGVPS RFSGSGSGTQ FSLKINSLQP EDFGTYYCQH FWNNPLTLGA GTKLELK | QVQLQQPGAE LAKPGTSVKM SCKASGYTFT SYWMNWIKQR PGQGLEWIGA VNPSNSYTEY AQKFKDKAIL TADKSSSTAY MSLSGLTSEA SAVYYCARSG LYNTNHLAWF AYWGQGTLVT VSAASTKGPS VFPLAPSSKS TSGGTAALGC LVKDYFPEPV TVSWNSGALT SGVHTFPAVL QSSGLYSLSS WTVPSSSLGT QTYICNVNHK PSNTKVDKKV EPKSCDKTHT CPPCPAPELL GGPSVFLFPP KPKDTLMISR TPEVTCVVVDV SHEDPEVKFN WYVDGVEVHN AKTKPREEQY NSTYRVVSVLT VLHQDWLNGK EYKCKVSNKA | DIQMTQSPAS LSASVGETVT ITCRASGNIH NYLAWYQQKQ GKSPQLLVFN AETLADGVPS RFSGSGSGTQ FSLKINSLQP EDFGTYYCQH FWNNPLTLGA GTKLELKRTV AAPSVFIFPP SDEQLKSGTA SWCLLNNFYP REAKVQWKVD NALQSGNSQE SVTEQDSKDS TYSLSSTLTL SKADYEKHKV YACEVTHQGL SSPVTKSFNR GEC |

TABLE 2-continued

VH and VL Amino Acid Sequences of CD8 Antibodies

| # | Protein Name | HC Isotype | LC Isotype | VH AA sequence | VL AA sequence | Heavy Chain AA sequence | Light Chain AA sequence |
|---|---|---|---|---|---|---|---|
| | | | | | | LPAPIEKTIS KAKGQPREPQ VYTLPPSREE MTKNQVSLTC LVKGFYPSDI AVEWESNGQP ENNYKTTPPV LDSDGSFFLY SKLTVDKSRW QQGNVFSCSV MHEALHNHYT QKSLSLSPGK | |
| | | | | 779 | 780 | 781 | 782 |
| 24 | CD8B350 | IgG1 | Kappa | EVQLQQSGAE LAKPGTSVKM SCKASGYTFA AYWINWLKQR PGQGLEWIGS INPSNGYTEY SQKFKDKAIL TADKSSSTAY MQLSSLTSED SAVYYCSRSG LYYTNHLAWC PYVJGQGTTV TVSS | DIVMTQSPAS LSASVGETVT ITCRASGNIH NYLAWYQQKQ GKSPQVLVYN AETLADSVPS RFSGSGSGTQ FSLKINSLQP EDFGNYYCQH FWNSPLTFGG GTKLEIK | EVQLQQSGAE LAKPGTSVKM SCKASGYTFA AYWINWLKQR PGQGLEWIGS INPSNGYTEY SQKFKDKAIL TADKSSSTAY MQLSSLTSED SAVYYCSRSG LYYTNHLAWC PYWGQGTTVT VSSASTKGPS VFPLAPSSKS TSGGTAALGC LVKDYFPEPV TVSWNSGALT SGVHTFPAVL QSSGLYSLSS WTVPSSSLGT QTYICNVNHK PSNTKVDKKV EPKSCDKTHT CPPCPAPELL GGPSVFLFPP KPKDTLMISR TPEVTCVWDV SHEDPEVKFN WYVDGVEVHN AKTKPREEQY NSTYRWSVLT VLHQDWLNGK EYKCKVSNKA LPAPIEKTIS KAKGQPREPQ VYTLPPSREE MTKNQVSLTC LVKGFYPSDI AVEWESNGQP ENNYKTTPPV LDSDGSFFLY SKLTVDKSRW QQGNVFSCSV MHEALHNHYT QKSLSLSPGK | DIVMTQSPAS LSASVGETVT ITCRASGNIH NYLAWYQQKQ GKSPQVLVYN AETLADSVPS RFSGSGSGTQ FSLKINSLQP EDFGNYYCQH FWNSPLTFGG GTKLEIKRTV AAPSVFIFPP SDEQLKSGTA SWCLLNNFYP REAKVQWKVD NALQSGNSQE SVTEQDSKDS TYSLSSTLTL SKADYEKHKV YACEVTHQGL SSPVTKSFNR GEC |
| | | | | 813 | 814 | 815 | 816 |
| 25 | CD8B356 | IgG1 | Kappa | DVQLQESGPG LVKPSQSLSL TCSVTGYSIT SGYYWNWIRQ FPGNKLEWMG YISYDGSNNY NPSLKNRISI TRDTSKNQFF LKLNSVTTED TATYYCVRN HGDAMDYWGQ GTSVTVSS | DIVLTQSQKF MSTTVGDRVS ITCKASQNVG TAVAWYQQKP GQSPKLLIYS ASYRYTGVPD RFTGSGSGTH FTLTISNMQS EDLADYFCQQ YSSYLTFGSG TKLEIK | DVQLQESGPG LVKPSQSLSL TCSVTGYSIT SGYYWNWIRQ FPGNKLEWMG YISYDGSNNY NPSLKNRISI TRDTSKNQFF LKLNSVTTED TATYYCVRNH GDAMDYWGQG TSVTVSSAST KGPSVFPLAP SSKSTSGGTA | DIVLTQSQKF MSTTVGDRVS ITCKASQNVG TAVAWYQQKP GQSPKLLIYS ASYRYTGVPD RFTGSGSGTH FTLTISNMQS EDLADYFCQQ YSSYLTFGSG TKLEIKRTVA APSVFIFPPS DEQLKSGTAS WCLLNNFYPR |

TABLE 2-continued

VH and VL Amino Acid Sequences of CD8 Antibodies

| Protein # | Name | HC Isotype | LC Isotype | VH AA sequence | VL AA sequence | Heavy Chain AA sequence | Light Chain AA sequence |
|---|---|---|---|---|---|---|---|
| | | | | | | ALGCLVKDYF PEPVTVSWNS GALTSGVHTF PAVLQSSGLY SLSSVVTVPS SSLGTQTYIC NVNHKPSNTK VDKKVEPKSC DKTHTCPPCP APELLGGPSV FLFPPKPKDT LMISRTPEVT CVWDVSHEDP EVKFNWYVDG VEVHNAKTKP REEQYNSTYR WSVLTVLHQD WLNGKEYKCK VSNKALPAPI EKTISKAKGQ PREPQVYTLP PSREEMTKNQ VSLTCLVK GFYPSDIAVE WESNGQPENN YKTTPPVLDS DGSFFLYSKL TVDKSRWQQG NVFSCSVMHE ALHNHYTQKS LSLSPGK | EAKVQWKVDN ALQSGNSQES VTEQDSKDST YSLSSTLTL SKADYEKHKV YACEVTHQGL SSPVTKSFNR GEC |
| | | | | 847 | 848 | 849 | 850 |
| 26 | CD8B369 | IgG1 | Kappa | QVQLQQSGAE LVKPGASVKL SCKTSGFTFT NTYISWLKQK PRQSLEWIAW IYTGTGGTWY NQKFTDKAQL TVDTSSSTAY MQVSSLTSED SAIYYCARTN WDWYFDVWGA GTSVTVSS | DIVMTQSPAS LSASVGETVT ITCRASENIY SYLAWYQQKQ GKSPQLLVYY AKTLTDGVPS RFSGSGSGTQ FSLKINSLQP EDFGSYYCQH HYGRPYTFGS GTKLEIK | QVQLQQSGAE LVKPGASVKL SCKTSGFTFT NTYISWLKQK PRQSLEWIAW IYTGTGGTWY NQKFTDKAQL TVDTSSSTAY MQVSSLTSED SAIYYCARTN WDWYFDVWGA GTSVTVSSAS TKGPSVFPLA PSSKSTSGGT AALGCLVKDY FPEPVTVSWN SGALTSGVHT FPAVLQSSGL YSLSSWTVPS SSLGTQTYIC NVNHKPSNTK VDKKVEPKSC DKTHTCPPCP APELLGGPSV FLFPPKPKDT LMISRTPEVT CVWDVSHEDP EVKFNWYVDG VEVHNAKTKP REEQYNSTYR WSVLTVLHQD WLNGKEYKCK VSNKALPAPI EKTISKAKGQ PREPQVYTLP PSREEMTKNQ VSLTCLVKGF YPSDIAVEWE SNGQPENNYK TTPPVLDSDG SFFLYSKLTV DKSRWQQGNV | DIVMTQSPAS LSASVGETVT ITCRASENIY SYLAWYQQKQ GKSPQLLVYY AKTLTDGVPS RFSGSGSGTQ FSLKINSLQP EDFGSYYCQH HYGRPYTFGS GTKLEIKRTV AAPSVFIFPP SDEQLKSGTA SWCLLNNFYP REAKVQWKVD NALQSGNSQE SVTEQDSKDS TYSLSSTLTL SKADYEKHKV YACEVTHQGL SSPVTKSFNR GEC |

TABLE 2-continued

VH and VL Amino Acid Sequences of CD8 Antibodies

| # | Protein Name | HC Isotype | LC Isotype | VH AA sequence | VL AA sequence | Heavy Chain AA sequence | Light Chain AA sequence |
|---|---|---|---|---|---|---|---|
| | | | | | | FSCSVMHEAL HNHYTQKSLS LSPGK | |
| | | | | 881 | 882 | 883 | 884 |
| 27 | CD8B371 | IgG1 | Kappa | EVKLVESGGG LVQPGSSMKL SCTASGFTFS DYYMAWVRQV PEKGLEWVAH INYDGSITYY LDSLKSRFII SRDNAKNILY LQMSSLKSED TATYYCARED YSNYGFAYWG QGTLVTVSA | NTQMNQTPSS LSASLGDTIT ITCHASQNIN VWLSWYQQKP GNIPKLLIYK ASNLHTGVPS RFSGSGSGTG FTLTISSLQP EDIATYYCQQ GQSYPLTFGS GTKLEMK | EVKLVESGGG LVQPGSSMKL SCTASGFTFS DYYMAWVRQV PEKGLEWVAH INYDGSITYY LDSLKSRFII SRDNAKNILY LQMSSLKSED TATYYCARED YSNYGFAYWG QGTLVTVSAA STKGPSVFPL APSSKSTSGG TAALGCLVKD YFPEPVTVSW NSGALTSGVH TFPAVLQSSG LYSLSSWTVP SSSLGTQTYI CNVNHKPSNT KVDKKVEPKS CDKTHTCPPC PAPELLGGPS VFLFPPKPKD TLMISRTPEV TCWVDVSHED PEVKFNWYVD GVEVHNAKTK PREEQYNSTY RWSVLTVLHQ DWLNGKEYKC KVSNKALPAP IEKTISKAKG QPREPQVYTL PPSREEMTKN QVSLTCLVKG FYPSDIAVEW ESNGQPENNY KTTPPVLDSD GSFFLYSKLT VDKSRWQQGN VFSCSVMHEA LHNHYTQKSL SLSPGK | NTQMNQTPSS LSASLGDTIT ITCHASQNIN VWLSWYQQKP GNIPKLLIYK ASNLHTGVPS RFSGSGSGTG FTLTISSLQP EDIATYYCQQ GQSYPLTFGS GTKLEMKRTV AAPSVFIFPP SDEQLKSGTA SWCLLNNFYP REAKVQWKVD NALQSGNSQE SVTEQDSKDS TYSLSSTLTL SKADYEKHKV YACEVTHQGL SSPVTKSFNR GEC |
| | | | | 915 | 916 | 917 | 918 |
| 28 | CD8B182 | IgG1 | Kappa | EVQLQQSGAA LAKPGTSVKM SCKASGYTFT SYWMNWVRQR PGQGLEWIGA VNPTNYYTEY IQKFKDKAIL TADKSSS TAYMHLSGLT SEDSAVYYCA RSGLYNTNHL AWFAYWGQGT TVTVSS | DIKMTQSPAS LSASVGETVT ITCRASENIH NYLAWYQQIQ GKSPQLLVYN AKTLANGVPS RFSGSASGTQ FSLTINSLQP EDFGSYYCQH FWTTPLTFGA GTKLELK | EVQLQQSGAA LAKPGTSVKM SCKASGYTFT SYWMNWVRQR PGQGLEWIGA VNPTNYYTEY IQKFKDKAIL TADKSSSTAY MHLSGLTSED SAVYYCARSG LYNTNHLAWF AYWGQGTTVT VSSASTKGPS VFPLAPSSKS TSGGTAALGC LVKDYFPEPV TVSWNSGALT SGVHTFPAVL QSSGLYSLSS VVTVPSSSLG TQTYICNVNH KPSNTKVDKK | DIKMTQSPAS LSASVGETVT ITCRASENIH NYLAWYQQIQ GKSPQLLVYN AKTLANGVPS RFSGSASGTQ FSLTINSLQP EDFGSYYCQH FWTTPLTFGA GTKLELKRTV AAPSVFIFPP SDEQLKSGTA SVVCLLNNFY PREAKVQWKV DNALQSGNSQ ESVTEQDSKD STYSLSSTLT LSKADYEKHK VYACEVTHQG LSSPVTKSFN RGEC |

TABLE 2-continued

VH and VL Amino Acid Sequences of CD8 Antibodies

| Protein # Name | HC Isotype | LC Isotype | VH AA sequence | VL AA sequence | Heavy Chain AA sequence | Light Chain AA sequence |
|---|---|---|---|---|---|---|
| | | | | | VEPKSCDKTH TCPPCPAPEL LGGPSVFLFP PKPKDTLMI SRTPEVTCVV VDVSHEDPEV KFNWYVDGVE VHNAKTKPRE EQYNSTYRVV SVLTVLHQDW LNGKEYKCKV SNKALPAPIE KTISKAKGQP REPQVYTLPP SREEMTKNQV SLTCLVKGFY PSDIAVEWES NGQPENNYKT TPPVLDSDGS FFLYSKLTVD KSRWQQGNVF SCSVMHEALH NHYTQKSLSL SPGK | |
| | | | 949 | 950 | 951 | 952 |
| 29 CD8B205 | IgG1 | Kappa | QVQLQQPGAE LVKPGASVKL SCKASGYSFN SYWMHWVKQR PGQGLEWIGN IDPSDSETHY NQKFKDKATL TVDKSSTAY MQLSSLTSED SAVYYCARVY YSYYSYDATY FDYWGQGTTL TVSS | DIQMTQSPAS LSASVGETVT ITCRASENIY SYLAWYQQKQ GKSPQLLVYN AKTLAEGVPS RFSGSGSGTQ FSLKINSLQP EDFGSYYCQH HYTTPLTFGG GTKLEIK | QVQLQQPGAE LVKPGASVKL SCKASGYSFN SYWMHWVKQR PGQGLEWIGN IDPSDSETHY NQKFKDKATL TVDKSSTAY MQLSSLTSED SAVYYCARVY YSYYSYDATY FDYWGQGTTL TVSSASTKGP SVFPLAPSSK STSGGTAALG CLVKDYFPEP VTVSWNSGAL TSGVHTFPAV LQSSGLYSLS SVVTVPSSSL GTQTYICNVN HKPSNTKVDK KVEPKSCDKT HTCPPCPAPE LLGGPSVFLF PPKPKDTLMI SRTPEVTCVV VDVSHEDPEV KFNWYVDGVE VHNAKTKPRE EQYNSTYRVV SVLTVLHQDW LNGKEYKCKV SNKALPAPIE KTISKAKGQP REPQVYTLPP SREEMTKNQV SLTCLVKGFY PSDIAVEWES NGQPENNYKT TPPVLDSDGS FFLYSKLTVD KSRWQQGNVF SCSVMHEALH NHYTQKSLSL SPGK | DIQMTQSPAS LSASVGETVT ITCRASENIY SYLAWYQQKQ GKSPQLLVYN AKTLAEGVPS RFSGSGSGTQ FSLKINSLQP EDFGSYYCQH HYTTPLTFGG GTKLEIKRTV AAPSVFIFPP SDEQLKSGTA SVVCLLNNFY PREAKVQWKV DNALQSGNSQ ESVTEQDSKD STYSLSSTLT LSKADYEKHK VYACEVTHQG LSSPVTKSFN RGEC |
| | | | 983 | 984 | 985 | 986 |

TABLE 2-continued

VH and VL Amino Acid Sequences of CD8 Antibodies

| Protein # Name | HC Isotype | LC Isotype | VH AA sequence | VL AA sequence | Heavy Chain AA sequence | Light Chain AA sequence |
|---|---|---|---|---|---|---|
| 30 CD8B223 | IgG1 | Kappa | DVQLQESGPI LVAPSQSLSI TCTVSGFSLT SYSVHWVRQP PGKGLEWLGV IWAGGSTNYN SAFMSRLTIS KDNSESQVFL KMISLQTDDT AMYYCAKHSY YSFDAFDYWG QGTTLTVSS | DIVMTQSQKF MSTSVGDRVR VTCKASQNVN TDVAWYQQKP GQSPKALIYS ASYRYSGVPD RFTGSGSGTD FTLTISNVQS EDLAEYFCQQ CNSYPLTFGA GTKLELK | DVQLQESGPI LVAPSQSLSI TCTVSGFSLT SYSVHWVRQP PGKGLEWLGV IWAGGSTNYN SAFMSRLTIS KDNSESQVFL KMISLQTDDT AMYYCAKHSY YSFDAFDYWG QGTTLTVSSA STKGPSVFPL APSSKSTSGG TAALGCLVKD YFPEPVTVSW NSGALTSGVH TFPAVLQSSG LYSLSSVVTV PSSSLGTQTY ICNVNHKPSN TKVDKKVEPK SCDKTHTCPP CPAPELLGGP SVFLFPPKPK DTLMISRTPE VTCVVVDVSH EDPEVKFNWY VDGVEVHNAK TKPREEQYNS TYRVVSVLTV LHQDWLNGKE YKCKVSNKAL PAPIEKTISK AKGQPREPQV YTLPPSREEM TKNQVSLTCL VKGFYPSDIA VEWESNGQPE NNYKTTPPVL DSDGSFFLYS KLTVDKSRWQ QGNVFSCSVM HEALHNHYTQ KSLSLSPGK | DIVMTQSQKF MSTSVGDRVR VTCKASQNVN TDVAWYQQKP GQSPKALIYS ASYRYSGVPD RFTGSGSGTD FTLTISNVQS EDLAEYFCQQ CNSYPLTFGA GTKLELKRTV AAPSVFIFPP SDEQLKSGTA SVVCLLNNFY PREAKVQWKV DNALQSGNSQ ESVTEQDSKD STYSLSSTLT LSKADYEKHK VYACEVTHQG LSSPVTKSFN RGEC |
|  |  |  | 1017 | 1018 | 1019 | 1020 |
| 31 CD8B234 | IgG1 | Kappa | QVQLKESGPG LVKPSQSLSL TCSVTGYSIT SGYYWNWIRQ FPGN KLEWMGYINY DGRNNYNPSL KNRISITRDT SKNHFFLKLN SVTTEDTATY YCSRDQGYSK FYFDYWGQGT TLTVSS | DIQMTQSSSS FSVSLGDRVT ITCKASEDIY NRLAWYQQRP GNAPRLLISG ATSLETGVPS RFSGGGSGKD YTLSITSLQT EDVANYYCQQ YWSFPRTFGG GTKLEIK | QVQLKESGPG LVKPSQSLSL TCSVTGYSIT SGYYWNWIRQ FPGNKLEWMG YINYDGRNNY NPSLKNRISI TRDTSKNHFF LKLNSVTTED TATYYCSRDQ GYSKFYFDYW GQGTTLTVSS ASTKGPSVFP LAPSSKSTSG GTAALGCL VKDYFPEPVT VSWNSGALTS GVHTFPAVLQ SSGLYSLSSV VTVPSSSLGT QTYICNVNHK PSNTKVDKKV EPKSCDKTHT CPPCPAPELL GGPSVFLFPP KPKDTLMISR TPEVTCVVVD | DIQMTQSSSS FSVSLGDRVT ITCKASEDIY NRLAWYQQRP GNAPRLLISG ATSLETGVPS RFSGGGSGKD YTLSITSLQT EDVANYYCQQ YWSFPRTFGG GTKLEIKRTV AAPSVFIFPP SDEQLKSGTA SVVCLLNNFY PREAKVQWKV DNALQSGNSQ ESVTEQDSKD STYSLSSTLT LSKADYEKHK VYACEVTHQG LSSPVTKSFN RGEC |

TABLE 2-continued

VH and VL Amino Acid Sequences of CD8 Antibodies

| # | Protein Name | HC Isotype | LC Isotype | VH AA sequence | VL AA sequence | Heavy Chain AA sequence | Light Chain AA sequence |
|---|---|---|---|---|---|---|---|
| | | | | | | VSHEDPEVKF NWYVDGVEVH NAKTKPREEQ YNSTYRVVSV LTVLHQDWLN GKEYKCKVSN KALPAPIEKT ISKAKGQPRE PQVYTLPPSR EEMTKNQVSL TCLVKGFYPS DIAVEWESNG QPENNYKTTP PVLDSDGSFF LYSKLTVDKS RWQQGNVFSC SVMHEALHNH YTQKSLSLSP GK | |
| | | | | 1051 | 1052 | 1053 | 1054 |
| 32 | CD8B251 | IgG1 | Kappa | QVQLKGSGPG LVQPSQSLSI TCTVSGFSLT TYAVHWVRQS PGKGLEWLGV IWSGGSTDYN AAFISRLSIS KDNSKSQVFF KMNSLQADDT AIYYCARHSY YHYNAMDNWG QGTSVTVSS | DIKMTQSQKF MSTTVGDRVS ITCKASQNVG TAVAWYQQKP GQSPKLLIYS ASNRYTGVPD RFTGSGSGTD FTLTISNMQS EDLADYFCQQ YSSYPFTFGS GTKLEIK | QVQLKGSGPG LVQPSQSLSI TCTVSGFSLT TYAVHWVRQS PGKGLEWLGV IWSGGSTDYN AAFISRLSIS KDNSKSQVFF KMNSLQADDT AIYYCARHSY YHYNAMDNWG QGTSVTVSSA STKGPSVFPL APSSKSTSGG TAALGCLVKD YFPEPVTVSW NSGALTSGVH TFPAVLQSSG LYSLSSVVTV PSSSLGTQTY ICNVNHKPSN TKVDKKVEPK SCDKTHTCPP CPAPELLGGP SVFLFPPKPK DTLMISRTPE VTCVVVDVSH EDPEVKFNWY VDGVEVHNAK TKPREEQYNS TYRVVSVLTV LHQDWLNGKE YKCKVSNKAL PAPIEKTISK AKGQPREPQV YTLPPSREEM TKNQVSLTCL VKGFYPSDIA VEWESNGQPE NNYKTTPPVL DSDGSFFLYS KLTVDKSRWQ QGNVFSCSVM HEALHNHYTQ KSLSLSPGK | DIKMTQSQKF MSTTVGDRVS ITCKASQNVG TAVAWYQQKP GQSPKLLIYS ASNRYTGVPD RFTGSGSGTD FTLTISNMQS EDLADYFCQQ YSSYPFTFGS GTKLEIKRTV AAPSVFIFPP SDEQLKSGTA SVVCLLNNFY PREAKVQWKV DNALQSGNSQ ESVTEQDSKD STYSLSSTLT LSKADYEKHK VYACEVTHQG LSSPVTKSFN RGEC |
| | | | | 1085 | 1086 | 1087 | 1088 |
| 33 | CD8B269 | IgG1 | Kappa | DVQLQESGPG LVKPSQSLSL TCSVTGYSIT SGYYWNWIRQ FPGNKLEWMG YISYDGSNNY NPSLKNRISI | DIVMTQSQKF MSTSVGDRVR VTCKASQNVG TDVAWYQQKP GQSPKALIYS ASYRYSGVPD RFTGSGSGTD | DVQLQESGPG LVKPSQSLSL TCSVTGYSIT SGYYWNWIRQ FPGNKLEWMG YISYDGSNNY NPSLKNRISI | DIVMTQSQKF MSTSVGDRVR VTCKASQNVG TDVAWYQQKP GQSPKALIYS ASYRYSGVPD RFTGSGSGTD |

TABLE 2-continued

VH and VL Amino Acid Sequences of CD8 Antibodies

| Protein # Name | HC Isotype | LC Isotype | VH AA sequence | VL AA sequence | Heavy Chain AA sequence | Light Chain AA sequence |
|---|---|---|---|---|---|---|
| | | | TRDTSKNQFF LKLNSVTTED TATYYCVRNH GDAMDHWGQG TTLTVSS | FTLTISDVQS EDLAEYFCQQ YKSYPLTFGA GTKLELK | TRDTSKNQFF LKLNSVTTED TATYYCVRNH GDAMDHWGQG TTLTVSSAST KGPSVFPLAP SSKSTSGGTA ALGCLVKDYF PEPVTVSWNS GALTSGVHTF PAVLQSSGLY SLSSVVTVPS SSLGTQTYIC NVNHKPSNTK VDKKVEPKSC DKTHTCPPCP APELLGGPSV FLFPPKPKDT LMISRTPEVT CVVVDVSHED PEVKFNWYVD GVEVHNAKTK PREEQYNSTY RVVSVLTVLH QDWLNGKEYK CKVSNKALPA PIEKTISKAK GQPREPQVYT LPPSREEMTK NQVSLTCLVK GFYPSDIAVE WESNGQPENN YKTTPPVLDS DGSFFLYSKL TVDKSRWQQG NVFSCSVMHE ALHNHYTQKS LSLSPGK | FTLTISDVQS EDLAEYFCQQ YKSYPLTFGA GTKLELKRTV AAPSVFIFPP SDEQLKSGTA SVVCLLNNFY PREAKVQWKV DNALQSGNSQ ESVTEQDSKD STYSLSSTLT LSKADYEKHK VYACEVTHQG LSSPVTKSFN RGEC |
| | | | 1119 | 1120 | 1121 | 1122 |
| 34 CD8B290 | IgG1 | Kappa | QVQLKESGPG LVAPSQSLSI TCTVSGFSLS RYSVHWVRQP PGKGLVWLGM IWGGGSTDYN SALKSRLSIS KDNSKSQVFL KMNSLQTDDT AMYYCARIYF DNYVGFAYWG QGTTLTVSS | DIVMTQSHKF MSTSVGDRVS ITCKASQDVG TVVAWYQQKP GQSPKLLIFW TSTRHTGVPD RFTGSGSGTD FTLTISNVQS EDLADYFCQQ YSSYPYTFGS GTKLELK | QVQLKESGPG LVAPSQSLSI TCTVSGFSLS RYSVHWVRQP PGKGLVWLGM IWGGGSTDYN SALKSRLSIS KDNSKSQVFL KMNSLQTDDT AMYYCARIYF DNYVGFAYWG QGTTLTVSSA STKGPSVFPL APSSKSTSGG TAALGCLVKD YFPEPVTVSW NSGALTSGVH TFPAVLQSSG LYSLSSVVTV PSSSLGTQTY ICNVNHKPSN TKVDKKVEPK SCDKTHTCPP CPAPELLGGP SVFLFPPKPK DTLMISRTPE VTCVVVDVSH EDPEVKFNWY VDGVEVHNAK TKPREEQYNS TYRVVSVLTV LHQDWLNGKE YKCKVSNKAL PAPIEKTISK AKGQPREPQV | DIVMTQSHKF MSTSVGDRVS ITCKASQDVG TVVAWYQQKP GQSPKLLIFW TSTRHTGVPD RFTGSGSGTD FTLTISNVQS EDLADYFCQQ YSSYPYTFGS GTKLELKRTV AAPSVFIFPP SDEQLKSGTA SVVCLLNNFY PREAKVQWKV DNALQSGNSQ ESVTEQDSKD STYSLSSTLT LSKADYEKHK VYACEVTHQG LSSPVTKSFN RGEC |

TABLE 2-continued

VH and VL Amino Acid Sequences of CD8 Antibodies

| Protein # Name | HC Isotype | LC Isotype | VH AA sequence | VL AA sequence | Heavy Chain AA sequence | Light Chain AA sequence |
|---|---|---|---|---|---|---|
| | | | | | YTLPPSREEM TKNQVSLTCL VKGFYPSDIA VEWESNGQPE NNYKTTPPVL DSDGSFFLYS KLTVDKSRWQ QGNVFSCSVM HEALHNHYTQ KSLSLSPGK | |
| | | | 1153 | 1154 | 1155 | 1156 |
| 35 CD8B310 | IgG1 | Kappa | QVQLKESGPG LVAPSQSLSI TCTVSGFSLT NYAVHWVRQS PGKGLEWLGV IWTDGSTDYN AGFISRLSIS KDNSKSQVFF KMNSLQADDT AIYYCARNNG YFPAFFAYWG QGTTVTVSS | DVLMTQTPLS LPVSLGDQAS ISCRSSQTIV HSNGNTYLEW YLQKPGQSPK LLMYKVSNRF SGVPDRFGGS GSGTDFTLKI SRVEAEDLGV YYCFQGSHAP FTFGSGTKLE IK | QVQLKESGPG LVAPSQSLSI TCTVSGFSLT NYAVHWVRQS PGKGLEWLGV IWTDGSTDYN AGFISRLSIS KDNSKSQVFF KMNSLQADDT AIYYCARNNG YFPAFFAYWG QGTTVTVSSA STKGPSVFPL APSSKSTSGG TAALGCLVKD YFPEPVTVSW NSGALTSGVH TFPAVLQSSG LYSLSSVVTV PSSSLGTQTY ICNVNHKPSN TKVDKKVEPK SCDKTHTCPP CPAPELLGGP SVFLFPPKPK DTLMISRTPE VTCVVVDVSH EDPEVKFNWY VDGVEVHNAK TKPREEQYNS TYRVVSVLTV LHQDWLNGKE YKCKVSNKAL PAPIEKTISK AKGQPREPQV YTLPPSREEM TKNQVSLTCL VKGFYPSDIA VEWESNGQPE NNYKTTPPVL DSDGSFFLYS KLTVDKSRWQ QGNVFSCSVM HEALHNHYTQ KSLSLSPGK | DVLMTQTPLS LPVSLGDQAS ISCRSSQTIV HSNGNTYLEW YLQKPGQSPK LLMYKVSNRF SGVPDRFGGS GSGTDFTLKI SRVEAEDLGV YYCFQGSHAP FTFGSGTKLE IKRTVAAPSV FIFPPSDEQL KSGTASVVCL LNNFYPREAK VQWKVDNALQ SGNSQESVTE QDSKDSTYSL SSTLTLSKAD YEKHKVYACE VTHQGLSSPV TKSFNRGEC |
| | | | 1187 | 1188 | 1189 | 1190 |
| 36 CD8B352 | IgG1 | Kappa | QVQLKESGPG LVKPSQSLSL TCSVTGYSIT SGYYWNWIRQ FPGNKLEWMG YINYDGRNNY NPSLRNRISI TRDTSKNHFF LKLNSVTTED TATYYCARDQ GYSKFYFDYW GQGTTLTVSS | DIQMTQSSSS FSVSLGDRVT ITCKASEDIY NRLAWYQQRP GNAPRLLISG ATSLETGVPS RFSGSGSGKD YTLSITSLQT EDVANYYCQQ YWSFPRTFGG GTKLEIK | QVQLKESGPG LVKPSQSLSL TCSVTGYSIT SGYYWNWIRQ FPGNKLEWMG YINYDGRNNY NPSLRNRISI TRDTSKNHFF LKLNSVTTED TATYYCARDQ GYSKFYFDYW GQGTTLTVSS ASTKGPSVFP LAPSSKSTSG GTAALGCLVK DYFPEPVTVS | DIQMTQSSSS FSVSLGDRVT ITCKASEDIY NRLAWYQQRP GNAPRLLISG ATSLETGVPS RFSGSGSGKD YTLSITSLQT EDVANYYCQQ YWSFPRTFGG GTKLEIKRTV AAPSVFIFPP SDEQLKSGTA SVVCLLNNFY PREAKVQWKV DNALQSGNSQ |

TABLE 2-continued

VH and VL Amino Acid Sequences of CD8 Antibodies

| Protein # Name | HC Isotype | LC Isotype | VH AA sequence | VL AA sequence | Heavy Chain AA sequence | Light Chain AA sequence |
|---|---|---|---|---|---|---|
| | | | | | WNSGALTSGV HTFPAVLQSS GLYSLSSVVT VPSSSLGTQT YICNVNHKPS NTKVDKKVEP KSCDKTHTCP PCPAPELLGG PSVFLFPPKP KDTLMISRTP EVTCVVVDVS HEDPEVKFNW YVDGVEVHNA KTKPREEQYN STYRVVSVLT VLHQDWLNGK EYKCKVSNKA LPAPIEKTIS KAKGQPREPQ VYTLPPSREE MTKNQVSLTC LVKGFYPSDI AVEWESNGQP ENNYKTTPPV LDSDGSFFLY SKLTVDKSRW QQGNVFSCSV MHEALHNHYT QKSLSLSPGK | ESVTEQDSKD STYSLSSTLT LSKADYEKHK VYACEVTHQG LSSPVTKSFN RGEC |
| | | | 1221 | 1222 | 1223 | 1224 |
| 37 CD8B319 | IgG1 | Kappa | QVQLKESGPE LKKPGETVKI SCKASGYSFT AYYMHWVKQS PEKSLEWIGE INPSAGGTTY NQKFKAKATL TVDKSSSTAF IQLKSLTSED SAVYYCARWT NPFDYWGQGT TLTVSS | DIVMTQSQKF MSTTVGDRVS ITCKASQNVG TAVAWYQQKP GQSPKLLIYS ASYRYTGVPD RFTGSGSGTH FTLTISNIQS EDLADYFCQQ YNNYLTFGSG TKLEIK | QVQLKESGPE LKKPGETVKI SCKASGYSFT AYYMHWVKQS PEKSLEWIGE INPSAGGTTY NQKFKAKATL TVDKSSSTAF IQLKSLTSED SAVYYCARWT NPFDYWGQGT TLTVSSASTK GPSVFPLAPS SKSTSGGTAA LGCLVKDYFP EPVTVSWNSG ALTSGVHTFP AVLQSSGLYS LSSVVTVPSS SLGTQTYICN VNHKPSNTKV DKKVEPKSCD KTHTCPPCPA PELLGGPSVF LFPPKPKDTL MISRTPEVTC VVVDVSHEDP EVKFNWYVDG VEVHNAKTKP REEQYNSTYR VVSVLTVLHQ DWLNGKEYKC KVSNKALPAP IEKTISKAKG QPREPQVYTL PPSREEMTKN QVSLTCLVKG FYPSDIAVEW ESNGQPENNY KTTPPVLDSD GSFFLYSKLT VDKSRWQQGN | DIVMTQSQKF MSTTVGDRVS ITCKASQNVG TAVAWYQQKP GQSPKLLIYS ASYRYTGVPD RFTGSGSGTH FTLTISNIQS EDLADYFCQQ YNNYLTFGSG TKLEIKRTVA APSVFIFPPS DEQLKSGTAS VVCLLNNFYP REAKVQWKVD NALQSGNSQE SVTEQDSKDS TYSLSSTLTL SKADYEKHKV YACEVTHQGL SSPVTKSFNR GEC |

TABLE 2-continued

VH and VL Amino Acid Sequences of CD8 Antibodies

| Protein # Name | HC Isotype | LC Isotype | VH AA sequence | VL AA sequence | Heavy Chain AA sequence | Light Chain AA sequence |
|---|---|---|---|---|---|---|
| | | | | | VFSCSVMHEA LHNHYTQKSL SLSPGK | |
| | | | 1255 | 1256 | 1257 | 1258 |
| 38 CD8B194 | IgG1 | Kappa | QVQLQQPGAE LVKPGASVKL SCKASGYTFT SYWINWVKQR PGQGLEWIGN IYPGSSSTNY NEKFKSKATL TVDTSSSAAY MQLSSLTSGD SAVYYCAREL GPYYRYSAMV YWGQGTTVTV SS | DIVMTQSQKF MSTTVGDRVS ITCKASQNVG TAVAWYQQKP GQSPKLLIYS ASNRYTGVPD RFTGSGSGTD FTLTISNMQS EDLADYFCQQ YSSYPFTFGS GTKLEIK | QVQLQQPGAE LVKPGASVKL SCKASGYTFT SYWINWVKQR PGQGLEWIGN IYPGSSSTNY NEKFKSKATL TVDTSSSAAY MQLSSLTSGD SAVYYCAREL GPYYRYSAMV YWGQGTTVTV SSASTKGPSV FPLAPSSKST SGGTAALGCL VKDYFPEPVT VSWNSGALTS GVHTFPAVLQ SSGLYSLSSV VTVPSSSLGT QTYICNVNHK PSNTKVDKKV EPKSCDKTHT CPPCPAPELL GGPSVFLFPP KPKDTLMISR TPEVTCVVVD VSHEDPEVKF NWYVDGVEVH NAKTKPREEQ YNSTYRVVSV LTVLHQDWLN GKEYKCKVSN KALPAPIEKT ISKAKGQPRE PQVYTLPPSR EEMTKNQVSL TCLVKGFYPS DIAVEWESNG QPENNYKTTP PVLDSDGSFF LYSKLTVDKS RWQQGNVFSC SVMHEALHNH YTQKSLSLSP GK | DIVMTQSQKF MSTTVGDRVS ITCKASQNVG TAVAWYQQKP GQSPKLLIYS ASNRYTGVPD RFTGSGSGTD FTLTISNMQS EDLADYFCQQ YSSYPFTFGS GTKLEIKRTV AAPSVFIFPP SDEQLKSGTA SVVCLLNNFY PREAKVQWKV DNALQSGNSQ ESVTEQDSKD STYSLSSTLT LSKADYEKHK VYACEVTHQG LSSPVTKSFN RGEC |
| | | | 1289 | 1290 | 1291 | 1292 |
| 39 CD8B231 | IgG1 | Kappa | EVKLVESGAE LVKPGASVKL SCKASGYTFT NYWMHWVKQR PGQGLEVJIG NIDPSDSETH YNQKFKDKAT LTVDKSSSTA YMQLSSLTS EDSAVYYCAS GLTGTGHYWG QGTTLTVSS | DIQMTQTTSS LSASLGDRVT ITCRASQDIN IYLNWYQQKP EGSIKCLIYH TSRLHSGVPS RFSGSGSGTD YSLTISNLEQ EDIATYFCQQ DNTLPYTFGS GTKLEIK | EVKLVESGAE LVKPGASVKL SCKASGYTFT NYWMHWVKQR PGQGLEWIGN IDPSDSETHY NQKFKDKATL TVDKSSSTAY MQLSSLTSED SAVYYCASGL TGTGHYWGQG TTLTVSSAST KGPSVFPLAP SSKSTSGGTA ALGCLVKDYF PEPVTVSWNS GALTSGVHTF PAVLQSSGLY SLSSVVTVPS SSLGTQTYIC NVNHKPSNTK VDKKVEPKSC | DIQMTQTTSS LSASLGDRVT ITCRASQDIN IYLNWYQQKP EGSIKCLIYH TSRLHSGVPS RFSGSGSGTD YSLTISNLEQ EDIATYFCQQ DNTLPYTFGS GTKLEIKRTV AAPSVFIFPP SDEQLKSGTA SVVCLLNNFY PREAKVQWKV DNALQSGNSQ ESVTEQDSKD STYSLSSTLT LSKADYEKHK VYACEVTHQG LSSPVTKSFN RGEC |

TABLE 2-continued

VH and VL Amino Acid Sequences of CD8 Antibodies

| Protein # Name | HC Isotype | LC Isotype | VH AA sequence | VL AA sequence | Heavy Chain AA sequence | Light Chain AA sequence |
|---|---|---|---|---|---|---|
| | | | | | DKTHTCPPCP APELLGGPSV FLFPPKPKDT LMISRTPEVT CVVVDVSHED PEVKFNWYVD GVEVHNAKTK PREEQY NSTYRVVSVL TVLHQDWLNG KEYKCKVSNK ALPAPIEKTI SKAKGQPREP QVYTLPPSRE EMTKNQVSLT CLVKGFYPSD IAVEWESNGQ PENNYKTTPP VLDSDGSFFL YSKLTVDKSR WQQGNVFSCS VMHEALHNHY TQKSLSLSPG K | |
| | | | 1323 | 1324 | 1325 | 1326 |
| 40 CD8B238 | IgG1 | Kappa | EFQLQQSGPE LVKPGASLKI SCKASGYTFT DYSMDWVKQS HGKTLEWIGY IYTYSGGAGY NRKFKSKATL TVDKSSSTAY LELHSLTSDD SAVYYCARDS SDYEFAYWGQ GTLVTVSA | DIKMTQSPSS MCPSLGERVT ITCKASQDIK SYLSWFQQKP GKSPKTLIYR ANRLVDGVPS RFSGSGSGQD YSLTISSLEY EDMGIYYCLQ YDEFRTFGGG TKLEIK | EFQLQQSGPE LVKPGASLKI SCKASGYTFT DYSMDWVKQS HGKTLEWIGY IYTYSGGAGY NRKFKSKATL TVDKSSSTAY LELHSLTSDD SAVYYCARDS SDYEFAYWGQ GTLVTVSAAS TKGPSVFPLA PSSKSTSGGT AALGCLVKDY FPEPVTVSWN SGALTSGVHT FPAVLQSSGL YSLSSVVTVP SSSLGTQTYI CNVNHKPSNT KVDKKVEPKS CDKTHTCPPC PAPELLGGPS VFLFPPKPKD TLMISRTPEV TCVVVDVSHE DPEVKFNWYV DGVEVHNAKT KPREEQYNST YRVVSVLTVL HQDWLNGKEY KCKVSNKALP APIEKTISKA KGQPREPQVY TLPPSREEMT KNQVSLTCLV KGFYPSDIAV EWESNGQPEN NYKTTPPVLD SDGSFFLYSK LTVDKSRWQQ GNVFSCSVMH EALHNHYTQK SLSLSPGK | DIKMTQSPSS MCPSLGERVT ITCKASQDIK SYLSWFQQKP GKSPKTLIYR ANRLVDGVPS RFSGSGSGQD YSLTISSLEY EDMGIYYCLQ YDEFRTFGGG TKLEIKRTVA APSVFIFPPS DEQLKSGTAS VVCLLNNFYP REAKVQWKVD NALQSGNSQE SVTEQDSKDS TYSLSSTLTL SKADYEKHKV YACEVTHQGL SSPVTKSFNR GEC |
| | | | 1357 | 1358 | 1359 | 1360 |

TABLE 2-continued

VH and VL Amino Acid Sequences of CD8 Antibodies

| Protein # Name | HC Isotype | LC Isotype | VH AA sequence | VL AA sequence | Heavy Chain AA sequence | Light Chain AA sequence |
|---|---|---|---|---|---|---|
| 41 CD8B255 | IgG1 | Kappa | QVTLKESGPG ILQPSQTLSL TCSFSGFSLN TSGMGVSWIR KPSGKGLEWL AHIFWDDDKR YNPSLKSRLT ISKDTSSNQV FLMITSVDTA DTATYYCARR DGYGDYAYFD VWGAGTLVTV SA | DIQMTQSPAS LSVSVGETVT ITCRASENIY SDLAWYQQKQ GKSPQLLVYA ATILTDGVPS RFSGSGSGTQ YSLKINSLQS EDFGNYYCQH FWGTPWTFGD GTRLEIK | QVTLKESGPG ILQPSQTLSL TCSFSGFSLN TSGMGVSWIR KPSGKGLEWL AHIFWDDDKR YNPSLKSRLT ISKDTSSNQV FLMITSVDTA DTATYYCARR DGYGDYAYFD VWGAGTLVTV SAASTKGPSV FPLAPSSKST SGGTAALGCL VKDYFPEPVT VSWNSGALTS GVHTFPAVLQ SSGLYSLSSV VTVPSSSLGT QTYICNVNHK PSNTKVDKKV EPKSCDKTHT CPPCPAPELL GGPSVFLFPP KPKDTLMISR TPEVTCVVVD VSHEDPEVKF NWYVDGVEVH NAKTKPREEQ YNSTYRVVSV LTVLHQDWLN GKEYKCKVSN KALPAPIEKT ISKAKGQPRE PQVYTLPPSR EEMTKNQVSL TCLVKGFYPS DIAVEWESNG QPENNYKTTP PVLDSDGSFF LYSKLTVDKS RWQQGNVFSC SVMHEALHNH YTQKSLSLSP GK | DIQMTQSPAS LSVSVGETVT ITCRASENIY SDLAWYQQKQ GKSPQLLVYA ATILTDGVPS RFSGSGSGTQ YSLKINSLQS EDFGNYYCQH FWGTPWTFGD GTRLEIKRTV AAPSVFIFPP SDEQLKSGTA SVVCLLNNFY PREAKVQWKV DNALQSGNSQ ESVTEQDSKD STYSLSSTLT LSKADYEKHK VYACEVTHQG LSSPVTKSFN RGEC |
|  |  |  | 1391 | 1392 | 1393 | 1394 |
| 42 CD8B324 | IgG1 | Kappa | QVQLQQPGAD LVKPGASVKL SCKASGYTST SHWIHWVKQR PGQGLEWIGN IYPGS SSTNYNEKFK RMATLTVDTS SSTVYMVLSS LTSDDSAVYY CARHSPGHRD YAMDYWGLGT SVTVSS | DIVMTQSQKF MPTTVGDRVS ITCKASQNVG TAVAWYQQKP GQSPKLLIAS ASNRYTGVPD RFTGSGSGTD FTLTISTMQS EDLADYFCQQ YSTYPLTFGA GTKLEMK | QVQLQQPGAD LVKPGASVKL SCKASGYTST SHWIHWVKQR PGQGLEWIGN IYPGSSSTNY NEKFKRMATL TVDTSSSTVY MVLSSLTSDD SAVYYCARHS PGHRDYAMDY WGLGTSVTVS SASTKGPSVF PLAPSSKSTS GGTAALGCLV KDYFPEPVTV SWNSGALTSG VHTFPAVLQS SGLYS LSSVVTVPSS SLGTQTYICN VNHKPSNTKV DKKVEPKSCD KTHTCPPCPA PELLGGPSVF LFPPKPKDTL | DIVMTQSQKF MPTTVGDRVS ITCKASQNVG TAVAWYQQKP GQSPKLLIAS ASNRYTGVPD RFTGSGSGTD FTLTISTMQS EDLADYFCQQ YSTYPLTFGA GTKLEMKRTV AAPSVFIFPP SDEQLKSGTA SVVCLLNNFY PREAKVQWKV DNALQSGNSQ ESVTEQDSKD STYSLSSTLT LSKADYEKHK VYACEVTHQG LSSPVTKSFN RGEC |

TABLE 2-continued

VH and VL Amino Acid Sequences of CD8 Antibodies

| Protein # Name | HC Isotype | LC Isotype | VH AA sequence | VL AA sequence | Heavy Chain AA sequence | Light Chain AA sequence |
|---|---|---|---|---|---|---|
| | | | | | MISRTPEVTC VVVDVSHEDP EVKFNWYVDG VEVHNAKTKP REEQYNSTYR VVSVLTVLHQ DWLNGKEYKC KVSNKALPAP IEKTISKAKG QPREPQVYTL PPSREEMTKN QVSLTCLVKG FYPSDIAVEW ESNGQPENNY KTTPPVLDSD GSFFLYSKLT VDKSRWQQGN VFSCSVMHEA LHNHYTQKSL SLSPGK | |
| | | | 1425 | 1426 | 1427 | 1428 |
| 43 CD8B337 | IgG1 | Kappa | QVTLKESGPG KVQPSQTLSL TCSFSGFSLS TSGMGVSWIR KPSGKGLEWL AHIFWDDDRR YKSSLKSRLT ISKDTSSNQV FLMITSVDTA DSATYYCARR VGYGDYAYFD VWGAGTTVTV SS | DIQMTQYPAS LSVSVGETVT ITCRASENIY SDLAWYQQKQ GKSPQLLVYA ATNLADGVPS RFSGSGSGTQ YSLKINSLQS EDFGNYYCQH FWGTPWTFGG GTKLEIK | QVTLKESGPG KVQPSQTLSL TCSFSGFSLS TSGMGVSWIR KPSGKGLEWL AHIFWDDDRR YKSSLKSRLT ISKDTSSNQV FLMITSVDTA DSATYYCARR VGYGDYAYFD VWGAGTTVTV SSASTKGPSV FPLAPSSKST SGGTAALGCL VKDYFPEPVT VSWNSGALTS GVHTFPAVLQ SSGLYSLSSV VTVPSSSLGT QTYICNVNHK PSNTKVDKKV EPKSCDKTHT CPPCPAPELL GGPSVFLFPP KPKDTLMISR TPEVTCVVVD VSHEDPEVKF NWYVDGVEVH NAKTKPREEQ YNSTYRVVSV LTVLHQDWLN GKEYKCKVSN KALPAPIEKT ISKAKGQPRE PQVYTLPPSR EEMTKNQVSL TCLVKGFYPS DIAVEWESNG QPENNYKTTP PVLDSDGSFF LYSKLTVDKS RWQQGNVFSC SVMHEALHNH YTQKSLSLSP GK | DIQMTQYPAS LSVSVGETVT ITCRASENIY SDLAWYQQKQ GKSPQLLVYA ATNLADGVPS RFSGSGSGTQ YSLKINSLQS EDFGNYYCQH FWGTPWTFGG GTKLEIKRTV AAPSVFIFPP SDEQLKSGTA SVVCLLNNFY PREAKVQWKV DNALQSGNSQ ESVTEQDSKD STYSLSSTLT LSKADYEKHK VYACEVTHQG LSSPVTKSFN RGEC |
| | | | 1459 | 1460 | 1461 | 1462 |
| 44 CD8B344 | IgG1 | Kappa | QVQLQQSGAE LVKPGASVKL SCKASGYSFT NYWINWMKQR PGQGLEWIGN | DIKMTQSQKF MSTTVGDRVS ITCKASQNVG TAVAWYQQKP GQSPKLLIYS | QVQLQQSGAE LVKPGASVKL SCKASGYSFT NYWINWMKQR PGQGLEWIGN | DIKMTQSQKF MSTTVGDRVS ITCKASQNVG TAVAWYQQKP GQSPKLLIYS |

TABLE 2-continued

VH and VL Amino Acid Sequences of CD8 Antibodies

| Protein # Name | HC Isotype | LC Isotype | VH AA sequence | VL AA sequence | Heavy Chain AA sequence | Light Chain AA sequence |
|---|---|---|---|---|---|---|
| | | | IYPGSDSSNY NEKFKTKATL TVDTSSSTAY MQLSSLTSDD SAVYYCAREE ADYRYTWFVY WGQGTLVTVS A | ASNRYTGVPD RFTGSGSGTD FTLTFSNMQS EDLADYFCQQ YSSYPLTFGA GTKLEMK | IYPGSDSSNY NEKFKTKATL TVDTSSSTAY MQLSSLTSDD SAVYYCAREE ADYRYTWFVY WGQGTLVTVS AASTKGPSVF PLAPSSKSTS GGTAALGCLV KDYFPEPVTV SWNSGALTSG VHTFPAVLQS SGLYSLSSVV TVPSSSLGTQ TYICNVNHKP SNTKVDKKVE PKSCDKTHTC PPCPAPELLG GPSVFLFPPK PKDTLMISRT PEVTCVVVDV SHEDPEVKFN WYVDGVEVHN AKTKPREEQY NSTYRVVSVL TVLHQDWLNG KEYKCKVSNK ALPAPIEKTI SKAKGQPREP QVYTLPPSRE EMTKNQVSLT CLVKGFYPSD IAVEWESNGQ PENNYKTTPP VLDSDGSFFL YSKLTVDKSR WQQGNVFSCS VMHEALHNHY TQKSLSLSPG K | ASNRYTGVPD RFTGSGSGTD FTLTFSNMQS EDLADYFCQQ YSSYPLTFGA GTKLEMKRTV AAPSVFIFPP SDEQLKSGTA SVVCLLNNFY PREAKVQWKV DNALQSGNSQ ESVTEQDSKD STYSLSSTLT LSKADYEKHK VYACEVTHQG LSSPVTKSFN RGEC |
| | | | 1493 | 1494 | 1495 | 1496 |
| 45 CD8B264 | IgG1 | Kappa | EVQLQQSGTE LVKPGASVKL SC KASGYSFTSY WINWVKQRPG QGPEWIGNIY PGSSSTNYNE KFKNKATLTV DTSSSTAYMQ LSSLTSDDSA VYYCAREEYS YKSSWFAYWG QGTLVTVSA | DIVMTQSQKF MSTTVGDRVS ITCKASQNVG TAVAWYQQKP GQSPKLLIYS ASNRYNGVPD RFTGSGSGTD FTLTISNMQS EDLADYFCQQ YSTYPYTFGS GTKLEIK | EVQLQQSGTE LVKPGASVKL SCKASGYSFT SYWINWVKQR PGQGPEWIGN IYPGSSSTNY NEKFKNKATL TVDT SSSTAYMQLS SLTSDDSAVY YCAREEYSYK SSWFAYWGQG TLVTVSAAST KGPSVFPLAP SSKSTSGGTA ALGCLVKDYF PEPVTVSWNS GALTSGVHTF PAVLQSSGLY SLSSVVTVPS SSLGTQTYIC NVNHKPSNTK VDKKVEPKSC DKTHTCPPCP APELLGGPSV FLFPPKPKDT LMISRTPEVT CVVVDVSHED PEVKFNWYVD GVEVHNAKTK PREEQYNSTY RVVSVLTVLH | DIVMTQSQKF MSTTVGDRVS ITCKASQNVG TAVAWYQQKP GQSPKLLIYS ASNRYNGVPD RFTGSGSGTD FTLTISNMQS EDLADYFCQQ YSTYPYTFGS GTKLEIKRTV AAPSVFIFPP SDEQLKSGTA SVVCLLNNFY PREAKVQWKV DNALQSGNSQ ESVTEQDSKD STYSLSSTLT LSKADYEKHK VYACEVTHQG LSSPVTKSFN RGEC |

TABLE 2-continued

VH and VL Amino Acid Sequences of CD8 Antibodies

| Protein # Name | HC Isotype | LC Isotype | VH AA sequence | VL AA sequence | Heavy Chain AA sequence | Light Chain AA sequence |
|---|---|---|---|---|---|---|
| | | | | | QDWLNGKEYK CKVSNKALPA PIEKTISKAK GQPREPQVYT LPPSREEMTK NQVSLTCLVK GFYPSDIAVE WESNGQPENN YKTTPPVLDS DGSFFLYSKL TVDKSRWQQG NVFSCSVMHE ALHNHYTQKS LSLSPGK | |
| | | | 1527 | 1528 | 1529 | 1530 |
| 46 CD8B318 | IgG1 | Kappa | EVQLQQSGAE LVKPGASVKL SCKASGYTFT SYWISWVKQR PGQGLEWIGN IYPGSSSSNY NENFKSKATL TVDTSSSTAH MQLSSLTSDD SAVFYCAREE YSYFPSWFAY WGQGTSVTVS S | DIVMTQSQKF MSTTIGDRVS ITCKASQNVG TAVAWFQQKP GQSPKLLIYS ASNRYTGVPD RFTGSGSGTD FTLTISNMQS EDLANYFCQQ YSTYPFTFGG GTKLEIK | EVQLQQSGAE LVKPGASVKL SCKASGYTFT SYWISWVKQR PGQGLEWIGN IYPGSSSSNY NENFKSKATL TVDTSSSTAH MQLSSLTSDD SAVFYCAREE YSYFPSWFAY WGQGTSVTVS SASTKGPSVF PLAPSSKSTS GGTAALGCLV KDYFPEPVTV SWNSGALTSG VHTFPAVLQS SGLYSLSSVV TVPSSSLGTQ TYICNVNHKP SNTKVDKKVE PKSCDKTHTC PPCPAPELLG GPSVFLFPPK PKDTLMISRT PEVTCVVVDV SHEDPEVKFN WYVDGVEVHN AKTKPREEQY NSTYRVVSVL TVLHQDWLNG KEYKCKVSNK ALPAPIEKTI SKAKGQPREP QVYTLPPSRE EMTKNQVSLT CLVKGFYPSD IAVEWESNGQ PENNYKTTPP VLDSDGSFFL YSKLTVDKSR WQQGNVFSCS VMHEALHNHY TQKSLSLSPG K | DIVMTQSQKF MSTTIGDRVS ITCKASQNVG TAVAWFQQKP GQSPKLLIYS ASNRYTGVPD RFTGSGSGTD FTLTISNMQS EDLANYFCQQ YSTYPFTFGG GTKLEIKRTV AAPSVFIFPP SDEQLKSGTA SVVCLLNNFY PREAKVQWKV DNALQSGNSQ ESVTEQDSKD STYSLSSTLT LSKADYEKHK VYACEVTHQG LSSPVTKSFN RGEC |
| | | | 1561 | 1562 | 1563 | 1564 |
| 47 CD8B333 | IgG1 | Kappa | QVQLQQPGTE LVKPGASVKL SCKASGYSFA SFWINWVKQR PGQGPEWIGN IYPGSSSTNY SEKFKNKATL TVDKSSSTAY MQLSSLTSDD SAVYYCAREE YSYKSSWFAY | DIVMTQSQKF MSTTVGDRVS ITCKASQNVG TAVAWYQQKP GQSPKLLIYS ASNRYNGVPD RFTGSGSGTD FTLTISNMQS EDLADYFCQQ YSTYPYTFGS GTKLELK | QVQLQQPGTE LVKPGASVKL SCKASGYSFA SFWINWVKQR PGQGPEWIGN IYPGSSSTNY SEKFKNKATL TVDKSSSTAY MQLSSLTSDD SAVYYCAREE YSYKSSWFAY | DIVMTQSQKF MSTTVGDRVS ITCKASQNVG TAVAWYQQKP GQSPKLLIYS ASNRYNGVPD RFTGSGSGTD FTLTISNMQS EDLADYFCQQ YSTYPYTFGS GTKLELKRTV |

TABLE 2-continued

VH and VL Amino Acid Sequences of CD8 Antibodies

| Protein # Name | HC Isotype | LC Isotype | VH AA sequence | VL AA sequence | Heavy Chain AA sequence | Light Chain AA sequence |
|---|---|---|---|---|---|---|
| | | | WGQGTTVTVSS | | WGQGTTVTVS SASTKGPSVF PLAPSSKSTS GGTAALGCLV KDYFPEPVTV SWNSGALTSG VHTFPAVLQS SGLYSLSSVV TVPSSSLGTQ TYICNVNHKP SNTKVDKKVE PKSCDKTHTC PPCPAPELLG GPSVFLFPPK PKDTLMISRT PEVTCVVVDV SHEDPEVKFN WYVDGVEVHN AKTKPREEQY NSTYRVVSVL TVLHQDWLNG KEYKCKVSNK ALPAPIEKTI SKAKGQPREP QVYTLPPSRE EMTKNQVSLT CLVKGFYPSD IAVEWESNGQ PENNYKTTPP VLDSDGSFFL YSKLTVDKSR WQQGNVFSCS VMHEALHNHY TQKSLSLSPG K | AAPSVFIFPP SDEQLKSGTA SVVCLLNNFY PREAKVQWKV DNALQSGNSQ ESVTEQDSKD STYSLSSTLT LSKADYEKHK VYACEVTHQG LSSPVTKSFN RGEC |
| | | | 1595 | 1596 | 1597 | 1598 |
| 48 CD8B366 | IgG1 | Kappa | EVQLQQSGPE LVRPGASVKL SCTASGFNIK DDYIHWVKQR PEQGLEWIGR IDPANGNPRY APKFQDKATL TADTSSNTAY LQLSSLTSED TAVYYCARDD EGYYYFDVWG AGTSVTVSS | DIKMTQSPSY LAASPGETIT INCRASKSIS KYLAWYQEKP GKTNKVLIYS GSTLQSGIPS RFSGSGSGTD FTLTISSLEP EDFAIYYCQQ HNEYPLTFGD GTRLEIK | EVQLQQSGPE LVRPGASVKL SCTASGFNIK DDYIHWVKQR PEQGLEWIGR IDPANGNPRY APKFQDKATL TADTSSNTAY LQLSSLTSED TAVYYCARDD EGYYYFDVWG AGTSVTVSSA STKGPSVFPL APSSKSTSGG TAALGCLVKD YFPEPVTVSW NSGALTSGVH TFPAVLQSSG LYSLSSVVTV PSSSLGTQTY ICNVNHKPSN TKVDKKVEPK SCDKTHTCPP CPAPELLGGP SVFLFPPKPK DTLMISRTPE VTCVVVDVSH EDPEVKFNWY VDGVEVHNAK TKPREEQYNS TYRVVSVLTV LHQDWLNGKE YKCKVSNKAL PAPIEKTISK AKGQPREPQV YTLPPSREEM TKNQVSLTCL VKGFYPSDIA | DIKMTQSPSY LAASPGETIT INCRASKSIS KYLAWYQEKP GKTNKVLIYS GSTLQSGIPS RFSGSGSGTD FTLTISSLEP EDFAIYYCQQ HNEYPLTFGD GTRLEIKRTV AAPSVFIFPP SDEQLKSGTA SVVCLLNNFY PREAKVQWKV DNALQSGNSQ ESVTEQDSKD STYSLSSTLT LSKADYEKHK VYACEVTHQG LSSPVTKSFN RGEC |

TABLE 2-continued

VH and VL Amino Acid Sequences of CD8 Antibodies

| # | Protein Name | HC Isotype | LC Isotype | VH AA sequence | VL AA sequence | Heavy Chain AA sequence | Light Chain AA sequence |
|---|---|---|---|---|---|---|---|
| | | | | | | VEWESNGQPE NNYKTTPPVL DSDGSFFLYS KLTVDKSRWQ QGNVFSCSVM HEALHNHYTQ KSLSLSPGK | |
| | | | | 1629 | 1630 | 1631 | 1632 |
| 49 | CD8B368 | IgG1 | Kappa | QVQLQQPGTE LVKPGASVKL SCKASGYTFT SYWINWMKQR PGQGLEWIGN TYPFSSSTNY NEKFKKKATL TVDASSSTAS MQLSSLTSDD SAVYFCAREE FSHYPSWFAY WGQGTTLTVS S | DIVMTQSQKF MSTTVGDRVS ITCKASQNVG IAVAWFQQKP GQSPKLLIYS ASNRYTGVPD RFTGSGSGTD FTLTIGNMQS EDLADYFCQQ YSTDPYTFGS GTKLEIK | QVQLQQPGTE LVKPGASVKL SCKASGYTFT SYWINWMKQR PGQGLEWIGN TYPFSSSTNY NEKFKKKATL TVDASSSTAS MQLSSLTSDD SAVYFCAREE FSHYPSWFAY WGQGTTLTVS SASTKGPSVF PLAPSSKSTS GGTAALGCLV KDYFPEPVTV SWNSGALTSG VHTFPAVLQS SGLYSLSSVV TVPSSSLGTQ TYICNVNHKP SNTKVDKKVE PKSCDKTHTC PPCPAPELLG GPSVFLFPPK PKDTLMISRT PEVTCVVVDV SHEDPEVKFN WYVDGVEVHN AKTKPREEQY NSTYRVVSVL TVLHQDWLNG KEYKCKVSNK ALPAPIEKTI SKAKGQPREP QVYTLPPSRE EMTKNQVSLT CLVKGFYPSD IAVEWESNGQ PENNYKTTPP VLDSDGSFFL YSKLTVDKSR WQQGNVFSCS VMHEALHNHY TQKSLSLSPG K | DIVMTQSQKF MSTTVGDRVS ITCKASQNVG IAVAWFQQKP GQSPKLLIYS ASNRYTGVPD RFTGSGSGTD FTLTIGNMQS EDLADYFCQQ YSTDPYTFGS GTKLEIKRTV AAPSVFIFPP SDEQLKSGTA SVVCLLNNFY PREAKVQWKV DNALQSGNSQ ESVTEQDSKD STYSLSSTLT LSKADYEKHK VYACEVTHQG LSSPVTKSFN RGEC |
| | | | | 1663 | 1664 | 1665 | 1666 |
| 50 | CD8B370 | IgG1 | Kappa | EVQLQQSGAE LVKPGASVKL SCKASGYTFT SYWINWVKQR PGQGLEWIGN IYPGSSSTNY NEKFKNKATL TVDTSSSTVY MQLSSLTSDD SAVYYCTREL GAYYHYSAMD YWGQGTSVTV SS | DIVLTQSQKI MSTTVGDRVS ITCKASQNVG TAVAWYQQKP GQSPKLLIYS ASNRYTGVPD RFTGSGSGTD FTLTISNMQS EDLADYFCQQ YSIYPFTFGS GTKLEIK | EVQLQQSGAE LVKPGASVKL SCKASGYTFT SYWINWVKQR PGQGLEWIGN IYPGSSSTNY NEKFKNKATL TVDTSSSTVY MQLSSLTSDD SAVYYCTREL GAYYHYSAMD YWGQGTSVTV SSASTKGPSV FPLAPSSKST SGGTAALGCL VKDYFPEPVT VSWNSGALTS GVHTFPAVLQ | DIVLTQSQKI MSTTVGDRVS ITCKASQNVG TAVAWYQQKP GQSPKLLIYS ASNRYTGVPD RFTGSGSGTD FTLTISNMQS EDLADYFCQQ YSIYPFTFGS GTKLEIKRTV AAPSVFIFPP SDEQLKSGTA SVVCLLNNFY PREAKVQWKV DNALQSGNSQ ESVTEQDSKD STYSLSSTLT |

TABLE 2-continued

VH and VL Amino Acid Sequences of CD8 Antibodies

| Protein # Name | HC Isotype | LC Isotype | VH AA sequence | VL AA sequence | Heavy Chain AA sequence | Light Chain AA sequence |
|---|---|---|---|---|---|---|
| | | | | | SSGLYSLSSV VTVPSSSLGT QTYICNVNHK PSNTKVDKKV EPKSCDKTHT CPPCPAPELL GGPSVFLPP KPKDTLMISR TPEVTCVVVD VSHEDPEVKF NWYVDGVEVH NAKTKPREEQ YNSTYRVVSV LTVLHQDWLN GKEYKCKVSN KALPAPIEKT ISKAKGQPRE PQVYTLPPSR EEMTKNQVSL TCLVKGFYPS DIAVEWESNG QPENNYKTTP PVLDSDGSFF LYSKLTVDKS RWQQGNVFSC SVMHEALHNH YTQKSLSLSP GK | LSKADYEKHK VYACEVTHQG LSSPVTKSFN RGEC |
| | | | 1697 | 1698 | 1699 | 1700 |
| 51 CD8B186 | IgG1 | Kappa | QVQLQQSGAE LAKPGASVKM SCKASGYIFT SYWMHWVKQR PGQGLEWIGN INPSSGYAVY NQKFKDKATL TADQSSSTAY IQLNSLTSED SAVYYCARRV FYGDSWFAYW GQGTSVTVSS | DVQMIQSPAS LSASVGETVT ITCRASGNIH NYLAWYQQKQ GKSPQLLVYN AKTLADGVPS RFSGSGSGTQ YSLKINSLQP EDFGSYYCQH FWSTTWTFGG GTKLEIK | QVQLQQSGAE LAKPGASVKM SCKASGYIFT SYWMHWVKQR PGQGLEWIGN INPSSGYAVY NQKFKDKATL TADQSSSTAY IQLNSLTSED SAVYYCARRV FYGDSWFAYW GQGTSVTVSS ASTKGPSVFP LAPSSKSTSG GTAALGCLVK DYFPEPVTVS WNSGALTSGV HTFPAVLQSS GLYSLSSVVT VPSSSLGTQT YICNVNHKPS NTKVDKKVEP KSCDKTHTCP PCPAPELLGG PSVFLFPPKP KDTLMISRTP EVTCVVVDVS HEDPEVKFNW YVDGVEVHNA KTKPREEQYN STYRVVSVLT VLHQDWLNGK EYKCKVSNKA LPAPIEKTIS KAKGQPREPQ VYTLPPSREE MTKNQVSLTC LVKGFYPSDI AVEWESNGQP ENNYKTTPPV LDSDGSFFLY SKLTVDKSRW | DVQMIQSPAS LSASVGETVT ITCRASGNIH NYLAWYQQKQ GKSPQLLVYN AKTLADGVPS RFSGSGSGTQ YSLKINSLQP EDFGSYYCQH FWSTTWTFGG GTKLEIKRTV AAPSVFIFPP SDEQLKSGTA SVVCLLNNFY PREAKVQWKV DNALQSGNSQ ESVTEQDSKD STYSLSSTLT LSKADYEKHK VYACEVTHQG LSSPVTKSFN RGEC |

TABLE 2-continued

VH and VL Amino Acid Sequences of CD8 Antibodies

| # | Protein Name | HC Isotype | LC Isotype | VH AA sequence | VL AA sequence | Heavy Chain AA sequence | Light Chain AA sequence |
|---|---|---|---|---|---|---|---|
| | | | | | | QQGNVFSCSV MHEALHNHYT QKSLSLSPGK | |
| | | | | 1731 | 1732 | 1733 | 1734 |
| 52 | CD8B190 | IgG1 | Kappa | EFQLQQSGPE LMKPGASVKI SCKASGYSFT SYYMHWMKQS HGKSLEWIGY IDPFNGNTNY KQKFKGKATL TVDKSSSTAY MHLSSLTSED SAVYYCASPN SNYVGTWFAY WGQGTTVTVS S | NTQMNQTPSS LSASLGDTVT ITCHASQNIN VWLSWYQQKP GNIPKLLIYK ASNLHTGVPS RFSGSGSGTG FTLTISSLQP DDIATYYCQQ GQSFPFTFGS GTKLEIK | EFQLQQSGPE LMKPGASVKI SCKASGYSFT SYYMHWMKQS HGKSLEWIGY IDPFNGNTNY KQKFKGKATL TVDKSSSTAY MHLSSLTSED SAVYYCASPN SNYVGTWFAY WGQGTTVTVS SASTKGPSVF PLAPSSKSTS GGTAALGCLV KDYFPEPVTV SWNSGALTSG VHTFPAVLQS SGLYSLSSVV TVPSSSLGTQ TYICNVNHKP SNTKVDKKVE PKSCDKTHTC PPCPAPELLG GPSVFLFPPK PKDTLMISRT PEVTCVVVDV SHEDPEVKFN WYVDGVEVHN AKTKPREEQY NSTYRVVSVL TVLHQDWLNG KEYKCKVSNK ALPAPIEKTI SKAKGQPREP QVYTLPPSRE EMTKNQVSLT CLVKGFYPSD IAVEWESNGQ PENNYKTTPP VLDSDGSFFL YSKLTVDKSR WQQGNVFSCS VMHEALHNHY TQKSLSLSPG K | NTQMNQTPSS LSASLGDTVT ITCHASQNIN VWLSWYQQKP GNIPKLLIYK ASNLHTGVPS RFSGSGSGTG FTLTISSLQP DDIATYYCQQ GQSFPFTFGS GTKLEIKRTV AAPSVFIFPP SDEQLKSGTA SVVCLLNNFY PREAKVQWKV DNALQSGNSQ ESVTEQDSKD STYSLSSTLT LSKADYEKHK VYACEVTHQG LSSPVTKSFN RGEC |
| | | | | 1765 | 1766 | 1767 | 1768 |
| 53 | CD8B192 | IgG1 | Kappa | QVQLQQSGPV LVKPGASVKM SCKASGYTFT DYYMNWVMQS HGKSLEWIGV INPYNGGTTY NQRFTGKATL TVDKSSS TAYMELNSLT SEDSAVYYCA RNYGAMDSWG QGTSVTVSS | DIQMTQSPAS LSASVGETVT ITCRASGNIH NYLAWYQQKQ GKSPQLLVSN AKTLADGVPS RFGGSGSGTQ YSLKINSLQP EDFGSYYCQH FWITPPTFGA GTRLEIK | QVQLQQSGPV LVKPGASVKM SCKASGYTFT DYYMNWVMQS HGKSLEWIGV INPYNGGTTY NQRFTGKATL TVDKSSSTAY MELNSLTSED SAVYYCARNY GAMDSWGQGT SVTVSSASTK GPSVFPLAPS SKSTSGGTAA LGCLVKDYFP EPVTVSWNSG ALTSGVHTFP AVLQSSGLYS LSSVVTVPSS SLGTQTYICN VNHKPSNTKV DKKVEPKSCD | DIQMTQSPAS LSASVGETVT ITCRASGNIH NYLAWYQQKQ GKSPQLLVSN AKTLADGVPS RFGGSGSGTQ YSLKINSLQP EDFGSYYCQH FWITPPTFGA GTRLEIKRTV AAPSVFIFPP SDEQLKSGTA SVVCLLNNFY PREAKVQWKV DNALQSGNSQ ESVTEQDSKD STYSLSSTLT LSKADYEKHK VYACEVTHQG LSSPVTKSFN RGEC |

TABLE 2-continued

VH and VL Amino Acid Sequences of CD8 Antibodies

| Protein # Name | HC Isotype | LC Isotype | VH AA sequence | VL AA sequence | Heavy Chain AA sequence | Light Chain AA sequence |
|---|---|---|---|---|---|---|
| | | | | | KTHTCPPCPA PELLGGPSVF LFPPKPKDTL MISRTPEVT CVVVDVSHED PEVKFNWYVD GVEVHNAKTK PREEQYNSTY RVVSVLTVLH QDWLNGKEYK CKVSNKALPA PIEKTISKAK GQPREPQVYT LPPSREEMTK NQVSLTCLVK GFYPSDIAVE WESNGQPENN YKTTPPVLDS DGSFFLYSKL TVDKSRWQQG NVFSCSVMHE ALHNHYTQKS LSLSPGK | |
| | | | 1799 | 1800 | 1801 | 1802 |
| 54 CD8B193 | IgG1 | Kappa | DVQLQESGPE LVKPGASVKI ACKTSGYKFT DYYMNWVKQS LGKSLDWIGD INPNGGGTSD NPKFKGKATL TVDKSSSTAY MELRSLTSED SGVYYCARTS GTDWYFDVWG TGTTVTVSS | DIVMTQSQKF MSTTVGDRVS ITCKASQNVG TAVAWYQQKP GQSPKLLIYS ASNRYTGVPD RFTGSGSGTD FTLTISNMQS EDLADYFCQQ YSSYPFTFGS GTKLEMK | DVQLQESGPE LVKPGASVKI ACKTSGYKFT DYYMNWVKQS LGKSLDWIGD INPNGGGTSD NPKFKGKATL TVDKSSSTAY MELRSLTSED SGVYYCARTS GTDWYFDVWG TGTTVTVSSA STKGPSVFPL APSSKSTSGG TAALGCLVKD YFPEPVTVSW NSGALTSGVH TFPAVLQSSG LYSLSSVVTV PSSSLGTQTY ICNVNHKPSN TKVDKKVEPK SCDKTHTCPP CPAPELLGGP SVFLFPPKPK DTLMISRTPE VTCVVVDVSH EDPEVKFNWY VDGVEVHNAK TKPREEQYNS TYRVVSVLTV LHQDWLNGKE YKCKVSNKAL PAPIEKTISK AKGQPREPQV YTLPPSREEM TKNQVSLTCL VKGFYPSDIA VEWESNGQPE NNYKTTPPVL DSDGSFFLYS KLTVDKSRWQ QGNVFSCSVM HEALHNHYTQ KSLSLSPGK | DIVMTQSQKF MSTTVGDRVS ITCKASQNVG TAVAWYQQKP GQSPKLLIYS ASNRYTGVPD RFTGSGSGTD FTLTISNMQS EDLADYFCQQ YSSYPFTFGS GTKLEMKRTV AAPSVFIFPP SDEQLKSGTA SVVCLLNNFY PREAKVQWKV DNALQSGNSQ ESVTEQDSKD STYSLSSTLT LSKADYEKHK VYACEVTHQG LSSPVTKSFN RGEC |
| | | | 1833 | 1834 | 1835 | 1836 |
| 55 CD8B214 | IgG1 | Kappa | QVQLQQSGPE LKKPGETVKI SCKASGYTFT | DIQMTQTTSS LSASLGDRVT ITCRASQDIR | QVQLQQSGPE LKKPGETVKI SCKASGYTFT | DIQMTQTTSS LSASLGDRVT ITCRASQDIR |

TABLE 2-continued

VH and VL Amino Acid Sequences of CD8 Antibodies

| Protein # | Name | HC Isotype | LC Isotype | VH AA sequence | VL AA sequence | Heavy Chain AA sequence | Light Chain AA sequence |
|---|---|---|---|---|---|---|---|
| | | | | TAGIQWVQKM PGKGFKWIGW INTHAGESKY ADDFKGRFAV SLETSASTAY LQISNLKNED TATYFCARSG DYDGSHPFAY WGQGTSVTVS S | PYLNWYQQKP EGTIKLLIYY TSRLHSGVPS RFSGSGSGTD YSLTISNLEQ EDIATYFCQQ DNTLPYTFGS GTKLEIK | TAGIQWVQKM PGKGFKWIGW INTHAGESKY ADDFKGRFAV SLETSASTAY LQISNLKNED TATYFCARSG DYDGSHPFAY WGQGTSVTVS SASTKGPSVF PLAPSSKSTS GGTAALGCLV KDYFPEPVTV SWNSGALTSG VHTFPAVLQS SGLYSLSSVV TVPSSSLGTQ TYICNVNHKP SNTKVDKKVE PKSCDKTHTC PPCPAPELLG GPSVFLFPPK PKDTLMISRT PEVTCVVVDV SHEDPEVKFN WYVDGVEVHN AKTKPREEQY NSTYRVVSVL TVLHQDWLNG KEYKCKVSNK ALPAPIEKTI SKAKGQPREP QVYTLPPSRE EMTKNQVSLT CLVKGFYPSD IAVEWESNGQ PENNYKTTPP VLDSDGSFFL YSKLTVDKSR WQQGNVFSCS VMHEALHNHY TQKSLSLSPG K | PYLNWYQQKP EGTIKLLIYY TSRLHSGVPS RFSGSGSGTD YSLTISNLEQ EDIATYFCQQ DNTLPYTFGS GTKLEIKRTV AAPSVFIFPP SDEQLKSGTA SVVCLLNNFY PREAKVQWKV DNALQSGNSQ ESVTEQDSKD STYSLSSTLT LSKADYEKHK VYACEVTHQG LSSPVTKSFN RGEC |
| | | | | 1867 | 1868 | 1869 | 1870 |
| 56 | CD8B230 | IgG1 | Kappa | QIQLVQSGPE LVKPGASVKI SCKASGYTFT DYYMNWVKQS HGKS LDWIGDINPN GGGTSDNPKF KGKATLTVDK SSNTAYMELR SLTSEDSAVY YCARTSGTDW YFDVWGTGTL VTVSA | DIVMTQSQKF MSTTVGDRVS ITCKASQNVG TAVAWYQQKP GQSPKLLIYS TSNRYTGVPD RFTGSGSGTD FTLTISNMQS EDLADYFCQQ YSIYPFTFGS GTKLEMK | QIQLVQSGPE LVKPGASVKI SCKASGYTFT DYYMNWVKQS HGKSLDWIGD INPNGGGTSD NPKFKGKATL TVDKSSNTAY MELRSLTSED SAVYYCARTS GTDWYFDVWG TGTLVTVSAA STKGPSVFPL APSSKSTSGG TAALGCLV KDYFPEPVTV SWNSGALTSG VHTFPAVLQS SGLYSLSSVV TVPSSSLGTQ TYICNVNHKP SNTKVDKKVE PKSCDKTHTC PPCPAPELLG GPSVFLFPPK PKDTLMISRT PEVTCVVVDV SHEDPEVKFN WYVDGVEVHN AKTKPREEQY | DIVMTQSQKF MSTTVGDRVS ITCKASQNVG TAVAWYQQKP GQSPKLLIYS TSNRYTGVPD RFTGSGSGTD FTLTISNMQS EDLADYFCQQ YSIYPFTFGS GTKLEMKRTV AAPSVFIFPP SDEQLKSGTA SVVCLLNNFY PREAKVQWKV DNALQSGNSQ ESVTEQDSKD STYSLSSTLT LSKADYEKHK VYACEVTHQG LSSPVTKSFN RGEC |

503 504

TABLE 2-continued

VH and VL Amino Acid Sequences of CD8 Antibodies

| Protein # Name | HC Isotype | LC Isotype | VH AA sequence | VL AA sequence | Heavy Chain AA sequence | Light Chain AA sequence |
|---|---|---|---|---|---|---|
| | | | | | NSTYRVVSVL TVLHQDWLNG KEYKCKVSNK ALPAPIEKTI SKAKGQPREP QVYTLPPSRE EMTKNQVSLT CLVKGFYPSD IAVEWESNGQ PENNYKTTPP VLDSDGSFFL YSKLTVDKSR WQQGNVFSCS VMHEALHNHY TQKSLSLSPG K | |
| | | | 1901 | 1902 | 1903 | 1904 |
| 57 CD8B245 | IgG1 | Kappa | EFQLQQSGGG LVQPGGSLSL SCAAPGFTFT DYYMSWVRQS PGKALEWLAL SRNKGNGYTT EYSASVKGRF TISRDNSQSI LYLQMNVLRA EDSATYYCAR HYGTPLTFGD TVTGTLFYYA LDYWGQGTTV TVSS | DIQMTQSPAS LSASVGETVT ITCRASENIY SYLAWYQQKQ GKSPQFLVYN AKTLAAGVPS RFSGSGSGTQ FSLKINRLQP EDFGTYYCQH HYGTPLTFGD GTRLEIK | EFQLQQSGGG LVQPGGSLSL SCAAPGFTFT DYYMSWVRQS PGKALEWLAL SRNKGNGYTT EYSASVKGRF TISRDNSQSI LYLQMNVLRA EDSATYYCAR HYGTPLTFGD TVTGTLFYYA LDYWGQGTTV TVSSASTKGP SVFPLAPSSK STSGGTAALG CLVKDYFPEP VTVSWNSGAL TSGVHTFPAV LQSSGLYSLS SVVTVPSSSL GTQTYICNVN HKPSNTKVDK KVEPKSCDKT HTCPPCPAPE LLGGPSVFLF PPKPKDTLMI SRTPEVTCVV VDVSHEDPEV KFNWYVDGVE VHNAKTKPRE EQYNSTYRVV SVLTVLHQDW LNGKEYKCKV SNKALPAPIE KTISKAKGQP REPQVYTLPP SREEMTKNQV SLTCLVKGFY PSDIAVEWES NGQPENNYKT TPPVLDSDGS FFLYSKLTVD KSRWQQGNVF SCSVMHEALH NHYTQKSLSL SPGK | DIQMTQSPAS LSASVGETVT ITCRASENIY SYLAWYQQKQ GKSPQFLVYN AKTLAAGVPS RFSGSGSGTQ FSLKINRLQP EDFGTYYCQH HYGTPLTFGD GTRLEIKRTV AAPSVFIFPP SDEQLKSGTA SVVCLLNNFY PREAKVQWKV DNALQSGNSQ ESVTEQDSKD STYSLSSTLT LSKADYEKHK VYACEVTHQG LSSPVTKSFN RGEC |
| | | | 1935 | 1936 | 1937 | 1938 |
| 58 CD8B248 | IgG1 | Kappa | EVQLQQSGAE LARPGASVKM SCKASGYTFT TYTMHWVKQR PGQGLEWIGY INPSSGYTKY NQKFTDKATL TADKSSSTAY MQLSSLTSED | DWMTQTPLSL PVSLGDQASI SCRSSQSLVH SSGNTYLHWY LQKPGQSPKL LIYKGSNRFS GVSDRFSGSG SGTDFTLKIS RVEAEDLGVY | EVQLQQSGAE LARPGASVKM SCKASGYTFT TYTMHWVKQR PGQGLEWIGY INPSSGYTKY NQKFTDKATL TADKSSSTAY MQLSSLTSED | DWMTQTPLSL PVSLGDQASI SCRSSQSLVH SSGNTYLHWY LQKPGQSPKL LIYKGSNRFS GVSDRFSGSG SGTDFTLKIS RVEAEDLGVY |

TABLE 2-continued

VH and VL Amino Acid Sequences of CD8 Antibodies

| Protein # Name | HC Isotype | LC Isotype | VH AA sequence | VL AA sequence | Heavy Chain AA sequence | Light Chain AA sequence |
|---|---|---|---|---|---|---|
| | | | SAVYYCARLW AYWGQGTLVT VSA | FCSQSTHVPF TFGSGTKLEM K | SAVYYCARLW AYWGQGTLVT VSAASTKGPS VFPLAPSSKS TSGGTAALGC LVKDYFPEPV TVSWNSGALT SGVHTFPAVL QSSGLYSLSS VVTVPSSSLG TQTYICNVNH KPSNTKVDKK VEPKSCDKTH TCPPCPAPEL LGGPSVFLFP PKPKDTLMIS RTPEVTCVVV DVSHEDPEVK FNWYVDGVEV HNAKTKPREE QYNSTYRVVS VLTVLHQDWL NGKEYKCKVS NKALPAPIEK TISKAKGQPR EPQVYTLPPS REEMTKNQVS LTCLVKGFYP SDIAVEWESN GQPENNYKTT PPVLDSDGSF FLYSKLTVDK SRWQQGNVFS CSVMHEALHN HYTQKSLSLS PGK | FCSQSTHVPF TFGSGTKLEM KRTVAAPSVF IFPPSDEQLK SGTASVVCLL NNFYPREAKV QWKVDNALQS GNSQESVTEQ DSKDSTYSLS STLTLSKADY EKHKVYACEV THQGLSSPVT KSFNRGEC |
| | | | 1969 | 1970 | 1971 | 1972 |
| 59 CD8B250 | IgG1 | Kappa | QVQLKESGPGL VAPSQSLSITC TVSGFSLSNY VVHWVRQSPG KGLEWLGVIW TDGSTDYNAA FISRLSISKD NSKSQVFFKM NSLQADDTAI YYCARNNGYF PAFFAYWGQG TLVTVSA | DIVMTQSQKF MSTSVGDRVS VTCKASQNVD TDITWYQQKP GQSPKALIYS ASYRYSGVPD RFTGSGSGTD FTLTITNVQS EDLAEYFCQQ YNSYPLTFGS GTKLEMK | QVQLKESGPG LVAPSQSLSI TCTVSGFSLS NYWHWVRQSP GKGLEWLGVI WTDGSTDYNA AFISRLSISK DNSKSQVFFKMNS LQADDTAIYY CARNNGYFPA FFAYWGQGTL VTVSAASTKG PSVFPLAPSS KSTSGGTAAL GCLVKDYFPE PVTVSWNSGA LTSGVHTFPA VLQSSGLYSL SSVVTVPSSS LGTQTYICNV NHKPSNTKVD KKVEPKSCDK THTCPPCPAP ELLGGPSVFL FPPKPKDTLM ISRTPEVTCV VVDVSHEDPE VKFNWYVDGV EVHNAKTKPR EEQYNSTYRV VSVLTVLHQD WLNGKEYKCK VSNKALPAPI EKTISKAKGQ PREPQVYTLP PSREEMTKNQ | DIVMTQSQKF MSTSVGDRVS VTCKASQNVD TDITWYQQKP GQSPKALIYS ASYRYSGVPD RFTGSGSGTD FTLTITNVQS EDLAEYFCQQ YNSYPLTFGS GTKLEMKRTV AAPSVFIFPP SDEQLKSGTA SVVCLLNNFY PREAKVQWKV DNALQSGNSQ ESVTEQDSKD STYSLSSTLT LSKADYEKHK VYACEVTHQG LSSPVTKSFN RGEC |

TABLE 2-continued

VH and VL Amino Acid Sequences of CD8 Antibodies

| Protein # Name | HC Isotype | LC Isotype | VH AA sequence | VL AA sequence | Heavy Chain AA sequence | Light Chain AA sequence |
|---|---|---|---|---|---|---|
| | | | | | VSLTCLVKGF YPSDIAVEWE SNGQPENNYK TTPPVLDSDG SFFLYSKLTV DKSRWQQGNV FSCSVMHEAL HNHYTQKSLS LSPGK | |
| | | | 2003 | 2004 | 2005 | 2006 |
| 60 CD8B254 | IgG1 | Kappa | EVQLQQSGAE LVKPGASVKM SCKTSGYTFS SYWITWVKQR PGQGLEWVGD IYPGSGSTNY NEKFKSKAAL TVDTSSSTAF MQLNSLTSED SAVYYCARES ITTRITPFDH WGQGTTLTVS S | DWMTQTPLSL PVSLGDQASI SCRSSQSLVH SSGNTYLHWY LQKPGQSPKL LIYKGSNRFS GVSDRFSGSG SGTDFTLKIS RVEAEDLGVY FCSQSTHVPF TFGSGTKLEI K | EVQLQQSGAE LVKPGASVKM SCKTSGYTFS SYWITWVKQR PGQGLEWVGD IYPGSGSTNY NEKFKSKAAL TVDTSSSTAF MQLNSLTSED SAVYYCARES ITTRITPFDH WGQGTTLTVS SASTKGPSVF PLAPSSKSTS GGTAALGCLV KDYFPEPVTV SWNSGALTSG VHTFPAVLQS SGLYSLSSVV TVPSSSLGTQ TYICNVNHKP SNTKVDKKVE PKSCDKTHTC PPCPAPELLG GPSVFLFPPK PKDTLMISRT PEVTCVVVDV SHEDPEVKFN WYVDGVEVHN AKTKPREEQY NSTYRVVSVL TVLHQDWLNG KEYKCKVSNK ALPAPIEKTI SKAKGQPREP QVYTLPPSRE EMTKNQVSLT CLVKGFYPSD IAVEWESNGQ PENNYKTTPP VLDSDGSFFL YSKLTVDKSR WQQGNVFSCS VMHEALHNHY TQKSLSLSPG K | DVVMTQTPLS LPVSLGDQAS ISCRSSQSLV HSSGNTYLHW YLQKPGQSPK LLIYKGSNRF SGVSDRFSGS GSGTDFTLKI SRVEAEDLGV YFCSQSTHVP FTFGSGTKLE IKRTVAAPSV FIFPPSDEQL KSGTASVVCL LNNFYPREAK VQWKVDNALQ SGNSQESVTE QDSKDSTYSL SSTLTLSKAD YEKHKVYACE VTHQGLSSPV TKSFNRGEC |
| | | | 2037 | 2038 | 2039 | 2040 |
| 61 CD8B261 | IgG1 | Kappa | QVQLQQPGAE LVKPGASVKL SCKASGYTFN SYWINWMKQR PGQGLEWIGN IYPGSSSTNY NEKFKSKATL TVDTSSSTAY MQLSSLTSDD SAVYYCAREL GGYYRYNAMD YWGQGTSVTV SS | DIVLTQSPSS MYASLGERVT ITCKASQDIN RYLSWFQQKP GKSPKTLIYR ANTLVDGVPS RFSGSGSGQD YSLTISSLEY EDMGIYYCLQ YDEFPYTFGS GTKLEMK | QVQLQQPGAE LVKPGASVKL SCKASGYTFN SYWINWMKQR PGQGLEWIGN IYPGSSSTNY NEKFKSKATL TVDTSSSTAY MQLSSLTSDD SAVYYCAREL GGYYRYNAMD YWGQGTSVTV SSASTKGPSV FPLAPSSKST SGGTAALGCL VKDYFPEPVT | DIVLTQSPSS MYASLGERVT ITCKASQDIN RYLSWFQQKP GKSPKTLIYR ANTLVDGVPS RFSGSGSGQD YSLTISSLEY EDMGIYYCLQ YDEFPYTFGS GTKLEMKRTV AAPSVFIFPP SDEQLKSGTA SVVCLLNNFY PREAKVQWKV DNALQSGNSQ |

TABLE 2-continued

VH and VL Amino Acid Sequences of CD8 Antibodies

| Protein # | Name | HC Isotype | LC Isotype | VH AA sequence | VL AA sequence | Heavy Chain AA sequence | Light Chain AA sequence |
|---|---|---|---|---|---|---|---|
| | | | | | | VSWNSGALTS GVHTFPAVLQ SSGLYSLSSV VTVPSSSLGT QTYICNVNHK PSNTKVDKKV EPKSCDKTHT CPPCPAPELL GGPSVFLPP KPKDTLMISR TPEVTCVVVD VSHEDPEVKF NWYVDGVEVH NAKTKPREEQ YNSTYRVVSV LTVLHQDWLN GKEYKCKVSN KALPAPIEKT ISKAKGQPRE PQVYTLPPSR EEMTKNQVSL TCLVKGFYPS DIAVEWESNG QPENNYKTTP PVLDSDGSFF LYSKLTVDKS RWQQGNVFSC SVMHEALHNH YTQKSLSLSP GK | ESVTEQDSKD STYSLSSTLT LSKADYEKHK VYACEVTHQG LSSPVTKSFN RGEC |
| | | | | 2071 | 2072 | 2073 | 2074 |
| 62 | CD8B311 | IgG1 | Kappa | QVQLKESGPE LVKPGASVKL SCKASGYTFT SYWMHWVKQR PGQGLEWIGM IHPNSGSTNY NEKFKSKATL TVDKSSSTAY MQLSSLTSED SAVYYCARCG YDGAWFAYWG QGTSVTVSS | DIQMTQTTSS LSASLGDRVT ISCSASQGIS NCLNWYQQKP DGTVKLLIHY TSSLHSGVPS RFSGGGSGTH YSLTISNLEP EDIATYYCQQ YSKVPYTFGS GTKLEIK | QVQLKESGPE LVKPGASVKL SCKASGYTFT SYWMHWVKQR PGQGLEWIGM IHPNSGSTNY NEKFKSKATL TVDKSSSTAY MQLSSLTSED SAVYYCARCG YDGAWFAYWG QGTSVTVSSA STKGPSVFPL APSSKSTGG TAALGCLVKD YFPEPVTVSW NSGALTSGVH TFPAVLQSSG LYSLSSVVTV PSSSLGTQTY ICNVNHKPSN TKVDKKVEPK SCDKTHTCPP CPAPELLGGP SVFLFPPKPK DTLMISRTPE VTCVVVDVSH EDPEVKFNWY VDGVEVHNAK TKPREEQYNS TYRVVSVLTV LHQDWLNGKE YKCKVSNKAL PAPIEKTISK AKGQPREPQV YTLPPSREEM TKNQVSLTCL VKGFYPSDIA VEWESNGQPE NNYKTTPPVL DSDGSFFLYS KLTVDKSRWQ QGNVFSCSVM | DIQMTQTTSS LSASLGDRVT ISCSASQGIS NCLNWYQQKP DGTVKLLIHY TSSLHSGVPS RFSGGGSGTH YSLTISNLEP EDIATYYCQQ YSKVPYTFGS GTKLEIKRTV AAPSVFIFPP SDEQLKSGTA SVVCLLNNFY PREAKVQWKV DNALQSGNSQ ESVTEQDSKD STYSLSSTLT LSKADYEKHK VYACEVTHQG LSSPVTKSFN RGEC |

TABLE 2-continued

VH and VL Amino Acid Sequences of CD8 Antibodies

| Protein # Name | HC Isotype | LC Isotype | VH AA sequence | VL AA sequence | Heavy Chain AA sequence | Light Chain AA sequence |
|---|---|---|---|---|---|---|
| | | | | | HEALHNHYTQ KSLSLSPGK | |
| | | | 2105 | 2106 | 2107 | 2108 |
| 63 CD8B340 | IgG1 | Kappa | QVQLQQPGAE LVKPGASVRL SCKASGYTFT NYWMQWVQQR PGQGLEWIGE IDPSDTFTNY NQNFKDKATL TVDTSSSTAY LQLSSLTSED SAVYYCARGD WDRDWYFDVW GTGTLVTVSA | DIVMTQTPLT LSVTIGQPAS ISCKSSQSLL YSDGKTYLNW LLQRPGESPK LLIYLVSKLD SGVPDRFTGS GSGTDFTLKI SRVETEDLGI YYCLQATHFP HTFGAGTKLE LK | QVQLQQPGAE LVKPGASVRL SCKASGYTFT NYWMQWVQQR PGQGLEWIGE IDPSDTFTNY NQNFKDKATL TVDTSSSTAY LQLSSLTSED SAVYYCARGD WDRDWYFDVW GTGTLVTVSA ASTKGPSVFP LAPSSKSTSG GTAALGCLVK DYFPEPVTVS WNSGALTSGV HTFPAVLQSS GLYSLSSVVT VPSSSLGTQT YICNVNHKPS NTKVDKKVEP KSCDKTHTCP PCPAPELLGG PSVFLFPPKP KDTLMISRTP EVTCVVVDVS HEDPEVKFNW YVDGVEVHNA KTKPREEQYN STYRVVSVLT VLHQDWLNGK EYKCKVSNKA LPAPIEKTIS KAKGQPREPQ VYTLPPSREE MTKNQVSLTC LVKGFYPSDI AVEWESNGQP ENNYKTTPPV LDSDGSFFLY SKLTVDKSRW QQGNVFSCSV MHEALHNHYT QKSLSLSPGK | DIVMTQTPLT LSVTIGQPAS ISCKSSQSLL YSDGKTYLNW LLQRPGESPK LLIYLVSKLD SGVPDRFTGS GSGTDFTLKI SRVETEDLGI YYCLQATHFP HTFGAGTKLE LKRTVAAPSV FIFPPSDEQL KSGTASVVCL LNNFYPREAK VQWKVDNALQ SGNSQESVTE QDSKDSTYSL SSTLTLSKAD YEKHKVYACE VTHQGLSSPV TKSFNRGEC |
| | | | 2139 | 2140 | 2141 | 2142 |
| 64 CD8B362 | IgG1 | Kappa | EVKLVESGAE LVKPGASVKL SCTASGFNIK DTYMHWVKQR PEQGLEWIGR IDPANGHTKF DPKFQGKATI TADTSSNTAY LQLSSLTSED TAVYYCAIRF AYWGQGTLVT VSA | DIQMTQSPSS LSASLGDRVS LTCRASHEIS GYLSWLQQKP DGTFKRLIYA ASTLDSGVPK RFSGSRSGSD YSLSISSLES EDFADYYCLQ YSSYPYTFGS GTKLEMK | EVKLVESGAE LVKPGASVKL SCTASGFNIK DTYMHWVKQR PEQGLEWIGR IDPANGHTKF DPKFQGKATI TADTSSNTAY LQLSSLTSED TAVYYCAIRF AYWGQGTLVT VSAASTKGPS VFPLAPSSKS TSGGTAALGC LVKDYFPEPV TVSWNSGALT SGVHTFPAVL QSSGLYSLSS VVTVPSSSLG TQTYICNVNH KPSNTKVDKK VEPKSCDKTH TCPPCPAPEL LGGPSVFLFP | DIQMTQSPSS LSASLGDRVS LTCRASHEIS GYLSWLQQKP DGTFKRLIYA ASTLDSGVPK RFSGSRSGSD YSLSISSLES EDFADYYCLQ YSSYPYTFGS GTKLEMKRTV AAPSVFIFPP SDEQLKSGTA SVVCLLNNFY PREAKVQWKV DNALQSGNSQ ESVTEQDSKD STYSLSSTLT LSKADYEKHK VYACEVTHQG LSSPVTKSFN RGEC |

TABLE 2-continued

VH and VL Amino Acid Sequences of CD8 Antibodies

| Protein<br># Name | HC<br>Isotype | LC<br>Isotype | VH<br>AA sequence | VL<br>AA sequence | Heavy Chain<br>AA sequence | Light Chain<br>AA sequence |
|---|---|---|---|---|---|---|
| | | | | | PKPKDTLMIS<br>RTPEVTCVVV<br>DVSHEDPEVK<br>FNWYVDGVEV<br>HNAKTKPREE<br>QYNSTYRVVS<br>VLTVLHQDWL<br>NGKEYKCKVS<br>NKALPAPIEK<br>TISKAKGQPR<br>EPQVYTLPPS<br>REEMTKNQVS<br>LTCLVKGFYP<br>SDIAVEWESN<br>GQPENNYKTT<br>PPVLDSDGSF<br>FLYSKLTVDK<br>SRWQQGNVFS<br>CSVMHEALHN<br>HYTQKSLSLS<br>PGK | |
| | | | 2173 | 2174 | 2175 | 2176 |

TABLE 3

Kabat CDR Amino Acid Sequences of CD8 Antibodies

| # | Protein<br>Name | HC<br>Kabat<br>CDR1 | HC Kabat CDR2 | HC Kabat CDR3 | LC Kabat<br>CDR1 | LC<br>Kabat<br>CDR2 | LC Kabat<br>CDR3 |
|---|---|---|---|---|---|---|---|
| 1 | CD8B191 | DYYMN<br>1 | RVIPSNGGTIYNLKFKG<br>2 | EDYNNQGFFLDAMDY<br>3 | RASQSISDFLH<br>4 | YASQSIS<br>5 | QNGHSFPYT<br>6 |
| 2 | CD8B226 | DYYMN<br>35 | RIIPSNGATIYNQKFKG<br>36 | EDYSNQGFFLDAMDY<br>37 | RASQSISHYLH<br>38 | YASQSIS<br>39 | QNGHSFPYT<br>40 |
| 3 | CD8B259 | DYYMN<br>69 | RVIPSNGGTIYNQKFRG<br>70 | EDYGNQGFFLDAMDY<br>71 | RASQSISHFLH<br>72 | YASQSIS<br>73 | QSGHSFPYT<br>74 |
| 4 | CD8B298 | DYYMN<br>103 | RVIPNNGGTRYNQKFKG<br>104 | EDFSNQGFFLDAMDY<br>105 | RASQTISDYLH<br>106 | YASQSIS<br>107 | QNGHSFPYT<br>108 |
| 5 | CD8B342 | DYYVN<br>137 | RVIPNNGNVIYNQNFKG<br>138 | EDYSNQGFFLDAMDY<br>139 | RASQTISNYLH<br>140 | YASQSIS<br>141 | QNGHSFPYT<br>142 |
| 6 | CD8B364 | SYWMH<br>171 | EINPSNGDSYYNEKFKR<br>172 | SMYYDGRAGAY<br>173 | ITSTDIDDDMN<br>174 | EGNTLRP<br>175 | LQSDNMPLT<br>176 |
| 7 | CD8B200 | NYWIH<br>205 | NIDPSDSETHYNQKFKD<br>206 | GLTGTGYY<br>207 | RASQDISPYLN<br>208 | YTSKLHS<br>209 | QQDNTLPYT<br>210 |
| 8 | CD8B247 | DYYMN<br>239 | RVIPNNGGTIYNQKFKD<br>240 | EDYSNQGFFLDAMDY<br>241 | RASQTISHFLH<br>242 | YASQSIS<br>243 | QSGHSFPYT<br>244 |
| 9 | CD8B265 | DYYMN<br>273 | RVIPRNGATTYNQNFRG<br>274 | EDFSNQGFFLDAMDY<br>275 | RASQSISHYLH<br>276 | YASQSIS<br>277 | QNGHSFPYT<br>278 |
| 10 | CD8B270 | NYWMH<br>307 | NIDPSDSETHYNQKFKD<br>308 | GLTGTGYY<br>309 | RASQDIRPYLN<br>310 | FTSKLHS<br>311 | QQDNTLPYT<br>312 |
| 11 | CD8B213 | DYYMD<br>341 | YIYPNNGITSYNQKFKG<br>342 | SIYYDHGGGFPY<br>343 | KASQNVDKYVA<br>344 | SASYRYS<br>345 | QQYNTYPS<br>346 |
| 12 | CD8B240 | DYYMN<br>375 | RVIPSNGGTIYNLKFKG<br>376 | EDYNNQGFFLDAMDY<br>377 | RASQSISDFLH<br>378 | YASQSIS<br>379 | QNGHSFPYT<br>380 |
| 13 | CD8B361 | DYYMD<br>409 | YIYPNNGDTRYNQKFKD<br>410 | SIYYDHGGGFPY<br>411 | KASQNVGTYVA<br>412 | SASYRYS<br>413 | QQYNSYPT<br>414 |
| 14 | CD8B246 | TSGMNVG<br>443 | HIWWDDDKYYNPSLKS<br>444 | RGNYGNYEFAY<br>445 | RASQDIRNYLN<br>446 | HTSRLHS<br>447 | QQGNTLPWT<br>448 |

TABLE 3-continued

Kabat CDR Amino Acid Sequences of CD8 Antibodies

| # | Protein Name | HC Kabat CDR1 | HC Kabat CDR2 | HC Kabat CDR3 | LC Kabat CDR1 | LC Kabat CDR2 | LC Kabat CDR3 |
|---|---|---|---|---|---|---|---|
| 15 | CD8B268 | VYTIH 477 | WFYPGSGNIKYNEKFKD 478 | HEDNHYYDGNSWFAYRASGNIHNYLA 479 | 480 | NAKTLAD 481 | QHFWNTPYT 482 |
| 16 | CD8B271 | IYSIH 511 | MIWGGGDTDYNSALKS 512 | NPHYYGGTYEYFDV 513 | SASQGISNYLN 514 | DTSILYS 515 | QQYSNLPYT 516 |
| 17 | CD8B273 | EYTIH 545 | WFYPGTGSIKYNEKFKD 546 | HEDNHYYDGNSWFAYRASGNIHNYLA 547 | 548 | NAKTLAD 549 | QHFWSTPYT 550 |
| 18 | CD8B288 | EYTIH 579 | WFYPGNGNMRYNEKFKD 580 | YEDNHYYDGASWFAYRASGNIHNYLA 581 | 582 | NAKTLAD 583 | QHFWSTPFT 584 |
| 19 | CD8B292 | DDYIY 613 | WIDPENGATEYASKFQG 614 | HDYGYAMDY 615 | TASSSVSSSYLH 616 | STSNLAS 617 | HQYHRSPLT 618 |
| 20 | CD8B303 | IYSIH 647 | MIWGGGSTDYNSTLNS 648 | NPHHYGGSTGAMDY 649 | KASQDIKKYMA 650 | YTSSLQP 651 | LQYDNLFT 652 |
| 21 | CD8B304 | TSGMNVG 681 | HIWWDDDKYYNPSLKS 682 | RGNYGNYEFAY 683 | RASQDIRNYLN 684 | HTSRLHS 685 | QQGNTLPWT 686 |
| 22 | CD8B312 | SFWMH 715 | NVDPSDSQTHYNQKFKD 716 | STYYRYDGPFTY 717 | RASQSINNNLH 718 | YTSQSIS 719 | QQSNSWPLT 720 |
| 23 | CD8B347 | SYWMN 749 | AVNPSNSYTEYAQKFKD 750 | SGLYNTNHLAWFAY 751 | RASGNIHNYLA 752 | NAETLAD 753 | QHFWNNPLT 754 |
| 24 | CD8B350 | AYWIN 783 | SINPSNGYTEYSQKFKD 784 | SGLYYTNHLAWCPY 785 | RASGNIHNYLA 786 | NAETLAD 787 | QHFWNSPLT 788 |
| 25 | CD8B356 | SGYYWN 817 | YISYDGSNNYNPSLKN 818 | NHGDAMDY 819 | KASQNVGTAVA 820 | SASYRYT 821 | QQYSSYLT 822 |
| 26 | CD8B369 | NTYIS 851 | WIYTGTGGTWYNQKFTD 852 | TNWDWYFDV 853 | RASENIYSYLA 854 | YAKTLTD 855 | QHHYGRPYT 856 |
| 27 | CD8B371 | DYYMA 885 | HINYDGSITYYLDSLKS 986 | EDYSNYGFAY 887 | HASQNINVWLS 888 | KASNLHT 889 | QQGQSYPLT 890 |
| 28 | CD8B182 | SYWMN 919 | AVNPTNYYTEYIQKFKD 920 | SGLYNTNHLAWFAY 921 | RASENIHNYLA 922 | NAKTLAN 923 | QHFWTTPLT 924 |
| 29 | CD8B205 | SYWMH 953 | NIDPSDSETHYNQKFKD 954 | VYYSYYSYDATYFDYRASENIYSYLA 955 | 956 | NAKTLAE 957 | QHHYTTPLT 958 |
| 30 | CD8B223 | SYSVH 987 | VIWAGGSTNYNSAFMS 988 | HSYYSFDAFDY 989 | KASQNVNTDVA 990 | SASYRYS 991 | QQCNSYPLT 992 |
| 31 | CD8B234 | SGYYWN 1021 | YINYDGRNNYNPSLKN 1022 | DQGYSKFYFDY 1023 | KASEDIYNRLA 1024 | GATSLET 1025 | QQYWSFPRT 1026 |
| 32 | CD8B251 | TYAVH 1055 | VIWSGGSTDYNAAFIS 1056 | HSYYHYNAMDN 1057 | KASQNVGTAVA 1058 | SASNRYT 1059 | QQYSSYPFT 1060 |
| 33 | CD8B269 | SGYYWN 1089 | YISYDGSNNYNPSLKN 1090 | NHGDAMDH 1091 | KASQNVGTDVA 1092 | SASYRYS 1093 | QQYKSYPLT 1094 |
| 34 | CD8B290 | RYSVH 1123 | MIWGGGSTDYNSALKS 1124 | IYFDNYVGFAY 1125 | KASQDVGTWA 1126 | WTSTRHT 1127 | QQYSSYPYT 1128 |
| 35 | CD8B310 | NYAVH 1157 | VIWTDGSTDYNAGFIS 1158 | NNGYFPAFFAY 1159 | RSSQTIVHSNGNTYLE 1160 | KVSNRFS 1161 | FQGSHAPFT 1162 |
| 36 | CD8B352 | SGYYWN 11S1 | YINYDGRNNYNPSLRN 1192 | DQGYSKFYFDY 1193 | KASEDIYNRLA 1194 | GATSLET 1195 | QQYWSFPRT 1196 |
| 37 | CD8B319 | AYYMH 1225 | EINPSAGGTTYNQKFKA 1226 | WTNPFDY 1227 | KASQNVGTAVA 1228 | SASYRYT 1229 | QQYNNYLT 1230 |
| 38 | CD8B194 | SYWIN 1259 | NIYPGSSSTNYNEKFKS 1260 | ELGPYYRYSAMVY 1261 | KASQNVGTAVA 1262 | SASNRYT 1263 | QQYSSYPFT 1264 |

TABLE 3-continued

Kabat CDR Amino Acid Sequences of CD8 Antibodies

| # | Protein Name | HC Kabat CDR1 | HC Kabat CDR2 | HC Kabat CDR3 | LC Kabat CDR1 | LC Kabat CDR2 | LC Kabat CDR3 |
|---|---|---|---|---|---|---|---|
| 39 | CD8B231 | NYWMH 1293 | NIDPSDSETHYNQKFKD 1294 | GLTGTGHY 1295 | RASQDINIYLN 1296 | HTSRLHS 1297 | QQDNTLPYT 1298 |
| 40 | CD8B238 | DYSMD 1327 | YIYTYSGGAGYNRKFKS 1328 | DSSDYEFAY 1329 | KASQDIKSYLS 1330 | RANRLVD 1331 | LQYDEFRT 1332 |
| 41 | CD8B255 | TSGMGVS 1361 | HIFWDDDKRYNPSLKS 1362 | RDGYGDYAYFDV 1363 | RASENIYSDLA 1364 | AATILTD 1365 | QHFWGTPWT 1366 |
| 42 | CD8B324 | SHWIH 1395 | NIYPGSSSTNYNEKFKR 1396 | HSPGHRDYAMDY 1397 | KASQNVGTAVA 1398 | SASNRYT 1399 | QQYSTYPLT 1400 |
| 43 | CD8B337 | TSGMGVS 1429 | HIFWDDDRRYKSSLKS 1430 | RVGYGDYAYFDV 1431 | RASENIYSDLA 1432 | AATNLAD 1433 | QHFWGTPWT 1434 |
| 44 | CD8B344 | NYWIN 1463 | NIYPGSDSSNYNEKFKT 1464 | EEADYRYTWFVY 1465 | KASQNVGTAVA 1466 | SASNRYT 1467 | QQYSSYPLT 1468 |
| 45 | CD8B264 | SYWIN 1497 | NIYPGSSSTNYNEKFKN 1498 | EEYSYKSSWFAY 1499 | KASQNVGTAVA 1500 | SASNRYN 1501 | QQYSTYPYT 1502 |
| 46 | CD8B318 | SYWIS 1531 | NIYPGSSSSNYNENFKS 1532 | EEYSYFPSWFAY 1533 | KASQNVGTAVA 1534 | SASNRYT 1535 | QQYSTYPFT 1536 |
| 47 | CD8B333 | SFWIN 1565 | NIYPGSSSTNYSEKFKN 1566 | EEYSYKSSWFAY 1567 | KASQNVGTAVA 1568 | SASNRYN 1569 | QQYSTYPYT 1570 |
| 48 | CD8B366 | DDYIH 1599 | RIDPANGNPRYAPKFQD 1600 | DDEGYYYFDV 1601 | RASKSISKYLA 1602 | SGSTLQS 1603 | QQHNEYPLT 1604 |
| 49 | CD8B368 | SYWIN 1633 | NIYPFSSSTNYNEKFKK 1634 | EEFSHYPSWFAY 1635 | KASQNVGIAVA 1636 | SASNRYT 1637 | QQYSTDPYT 1638 |
| 50 | CD8B370 | SYWIN 1667 | NIYPGSSSTNYNEKFKN 1668 | ELGAYYHYSAMDY 1669 | KASQNVGTAVA 1670 | SASNRYT 1671 | QQYSIYPFT 1672 |
| 51 | CD8B186 | SYWMH 1701 | NINPSSGYAVYNQKFKD 1702 | RVFYGDSWFAY 1703 | RASGNIHNYLA 1704 | NAKTLAD 1705 | QHFWSTTWT 1706 |
| 52 | CD8B190 | SYYMH 1735 | YIDPFNGNTNYKQKFKG 1736 | PNSNYVGTWFAY 1737 | HASQNINVWLS 1738 | KASNLHT 1739 | QQGQSFPFT 1740 |
| 53 | CD8B192 | DYYMN 1769 | VINPYNGGTTYNQRFTG 1770 | NYGAMDS 1771 | RASGNIHNYLA 1772 | NAKTLAD 1773 | QHFWITPPT 1774 |
| 54 | CD8B193 | DYYMN 1803 | DINPNGGGTSDNPKFKG 1804 | TSGTDWYFDV 1805 | KASQNVGTAVA 1806 | SASNRYT 1807 | QQYSSYPFT 1808 |
| 55 | CD8B214 | TAGIQ 1837 | WINTHAGESKYADDFKG 1838 | SGDYDGSHPFAY 1839 | RASQDIRPYLN 1840 | YTSRLHS 1841 | QQDNTLPYT 1842 |
| 56 | CD8B230 | DYYMN 1871 | DINPNGGGTSDNPKFKG 1872 | TSGTDWYFDV 1873 | KASQNVGTAVA 1874 | STSNRYT 1875 | QQYSIYPFT 1876 |
| 57 | CD8B245 | DYYMS 1905 | LSRNKGNGYTTEYSASVKG 1906 | TVTGTLFYYALDY 1907 | RASENIYSYLA 1908 | NAKTLAA 1909 | QHHYGTPLT 1910 |
| 58 | CD8B248 | TYTMH 1939 | YINPSSGYTKYNQKFTD 1940 | LWAY 1941 | RSSQSLVHSSGNTYLH 1942 | KGSNRFS 1943 | SQSTHVPFT 1944 |
| 59 | CD8B250 | NYVVH 1973 | VIWTDGSTDYNAAFIS 1974 | NNGYFPAFFAY 1975 | KASQNVDTDIT 1976 | SASYRYS 1977 | QQYNSYPLT 1978 |
| 60 | CD8B254 | SYWIT 2007 | DIYPGSGSTNYNEKFKS 2008 | ESITTRITPFDH 2009 | RSSQSLVHSSGNTYLH 2010 | KGSNRFS 2011 | SQSTHVPFT 2012 |
| 61 | CD8B261 | SYWIN 2041 | NIYPGSSSTNYNEKFKS 2042 | ELGGYYRYNAMDY 2043 | KASQDINRYLS 2044 | RANTLVD 2045 | LQYDEFPYT 2046 |
| 62 | CD8B311 | SYWMH 2075 | MIHPNSGSTNYNEKFKS 2076 | CGYDGAWFAY 2077 | SASQGISNCLN 2078 | YTSSLHS 2079 | QQYSKVPYT 2080 |

TABLE 3-continued

Kabat CDR Amino Acid Sequences of CD8 Antibodies

| Protein # Name | HC Kabat CDR1 | HC Kabat CDR2 | HC Kabat CDR3 | LC Kabat CDR1 | LC Kabat CDR2 | LC Kabat CDR3 |
|---|---|---|---|---|---|---|
| 63 CD8B340 | NYWMQ 2109 | EIDPSDTFTNYNQNFKD 2110 | GDWDRDWYFDV 2111 | KSSQSLLYSDGKTYLN 2112 | LVSKLDS 2113 | LQATHFPHT 2114 |
| 64 CD8B362 | DTYMH 2143 | RIDPANGHTKFDPKFQG 2144 | RFAY 2145 | RASHEISGYLS 2146 | AASTLDS 2147 | LQYSSYPYT 2148 |

TABLE 4

Chothia CDR Amino Acid Sequences of CD8 Antibodies

| Protein # Name | HC Chothia CDR1 | HC Chothia CDR2 | HC Chothia CDR3 | LC Chothia CDR1 | LC Chothia CDR2 | LC Chothia CDR3 |
|---|---|---|---|---|---|---|
| 1 CD8B191 | GYTFTDY 7 | IPSNGG 8 | EDYNNQGFFLDAMD 9 | SQSISDF 10 | YAS 11 | GHSFPY 12 |
| 2 CD8B226 | GYTFTDY 41 | IPSNGA 42 | EDYSNQGFFLDAMD 43 | SQSISHY 44 | YAS 45 | GHSFPY 46 |
| 3 CD8B259 | GYTFTDY 75 | IPSNGG 76 | EDYGNQGFFLDAMD 77 | SQSISHF 78 | YAS 79 | GHSFPY 80 |
| 4 CD8B298 | GYTFTDY 109 | IPNNGG 110 | EDFSNQGFFLDAMD 111 | SQTISDY 112 | YAS 113 | GHSFPY 114 |
| 5 CD8B342 | GYTFTDY 143 | IPNNGN 144 | EDYSNQGFFLDAMD 145 | SQTISNY 146 | YAS 147 | GHSFPY 148 |
| 6 CD8B364 | GYTFTSY 177 | NPSNGD 178 | SMYYDGRAGA 179 | STDIDDD 180 | EGN 181 | SDNMPL 182 |
| 7 CD8B200 | GYTFTNY 211 | DPSDSE 212 | GLTGTGY 213 | SQDISPY 214 | YTS 215 | DNTLPY 216 |
| 8 CD8B247 | GYTFTDY 245 | IPNNGG 246 | EDYSNQGFFLDAMD 247 | SQTISHF 248 | YAS 249 | GHSFPY 250 |
| 9 CD8B265 | GYSFTDY 279 | IPRNGA 280 | EDFSNQGFFLDAMD 281 | SQSISHY 282 | YAS 283 | GHSFPY 284 |
| 10 CD8B270 | GYTFTNY 313 | DPSDSE 314 | GLTGTGY 315 | SQDIRPY 316 | FTS 317 | DNTLPY 318 |
| 11 CD8B213 | GYIFTDY 347 | YPNNGI 348 | SIYYDHGGGFP 349 | SQNVDKY 350 | SAS 351 | YNTYP 352 |
| 12 CD8B240 | GYTFTDY 381 | IPSNGG 382 | EDYNNQGFFLDAMD 383 | SQSISDF 384 | YAS 385 | GHSFPY 386 |
| 13 CD8B361 | GYTFTDY 415 | YPNNGD 416 | SIYYDHGGGFP 417 | SQNVGTY 418 | SAS 419 | YNSYP 420 |
| 14 CD8B246 | GFSLSTSGM 449 | WWDDD 450 | RGNYGNYEFA 451 | SQDIRNY 452 | HTS 453 | GNTLPW 454 |
| 15 CD8B268 | GYTFTVY 483 | YPGSGN 484 | HEDNHYYDGNSWFA 485 | SGNIHNY 486 | NAK 487 | FWNTPY 488 |
| 16 CD8B271 | GFSLSIY 517 | WGGGD 518 | NPHYYGGTYEYFD 519 | SQGISNY 520 | DTS 521 | YSNLPY 522 |
| 17 CD8B273 | GYTFTEY 551 | YPGTGS 552 | HEDNHYYDGNSWFA 553 | SGNIHNY 554 | NAK 555 | FWSTPY 556 |
| 18 CD8B288 | GYTFTEY 585 | YPGNGN 586 | YEDNHYYDGASWFA 587 | SGNIHNY 588 | NAK 589 | FWSTPF 590 |
| 19 CD8B292 | GFNFKDD 619 | DPENGA 620 | HDYGYAMD 621 | SSSVSSSY 622 | STS 623 | YHRSPL 624 |

TABLE 4-continued

Chothia CDR Amino Acid Sequences of CD8 Antibodies

| # | Protein Name | HC Chothia CDR1 | HC Chothia CDR2 | HC Chothia CDR3 | LC Chothia CDR1 | LC Chothia CDR2 | LC Chothia CDR3 |
|---|---|---|---|---|---|---|---|
| 20 | CD8B303 | GFSLSIY 653 | WGGGS 654 | NPHHYGGSTGAMD 655 | SQDIKKY 656 | YTS 657 | YDNLF 658 |
| 21 | CD8B304 | GFSLSTSGM 687 | WWDDD 688 | RGNYGNYEFA 689 | SQDIRNY 690 | HTS 691 | GNTLPW 692 |
| 22 | CD8B312 | GYTFTSF 721 | DPSDSQ 722 | STYYRYDGPFT 723 | SQSINNN 724 | YTS 725 | SNSWPL 726 |
| 23 | CD8B347 | GYTFTSY 755 | NPSNSY 756 | SGLYNTNHLAWFA 757 | SGNIHNY 758 | NAE 759 | FWNNPL 760 |
| 24 | CD8B350 | GYTFAAY 789 | NPSNGY 790 | SGLYYTNHLAWCP 791 | SGNIHNY 792 | NAE 793 | FWNSPL 794 |
| 25 | CD8B356 | GYSITSGY 823 | SYDGS 824 | NHGDAMD 825 | SQNVGTA 826 | SAS 827 | YSSYL 828 |
| 26 | CD8B369 | GFTFTNT 857 | YTGTGG 858 | TNWDWYFD 859 | SENIYSY 860 | YAK 861 | HYGRPY 862 |
| 27 | CD8B371 | GFTFSDY 891 | NYDGSI 892 | EDYSNYGFA 893 | SQNINVW 894 | KAS 895 | GQSYPL 896 |
| 28 | CD8B182 | GYTFTSY 925 | NPTNYY 926 | SGLYNTNHLAWFA 927 | SENIHNY 928 | NAK 929 | FWTTPL 930 |
| 29 | CD8B205 | GYSFNSY 959 | DPSDSE 960 | VYYSYYSYDATYFD 961 | SENIYSY 962 | NAK 963 | HYTTPL 964 |
| 30 | CD8B223 | GFSLTSY 993 | WAGGS 994 | HSYYSFDAFD 995 | SQNVNTD 996 | SAS 997 | CNSYPL 998 |
| 31 | CD8B234 | GYSITSGY 1027 | NYDGR 1028 | DQGYSKFYFD 1029 | SEDIYNR 1030 | GAT 1031 | YWSFPR 1032 |
| 32 | CD8B251 | GFSLTTY 1061 | WSGGS 1062 | HSYYHYNAMD 1063 | SQNVGTA 1064 | SAS 1065 | YSSYPF 1066 |
| 33 | CD8B269 | GYSITSGY 1095 | SYDGS 1096 | NHGDAMD 1097 | SQNVGTD 1098 | SAS 1099 | YKSYPL 1100 |
| 34 | CD8B290 | GFSLSRY 1129 | WGGGS 1130 | IYFDNYVGFA 1131 | SQDVGTV 1132 | WTS 1133 | YSSYPY 1134 |
| 35 | CD8B310 | GFSLTNY 1163 | WTDGS 1164 | NNGYFPAFFA 1165 | SQTIVHSNGNTY 1166 | KVS 1167 | GSHAPF 1168 |
| 36 | CD8B352 | GYSITSGY 1197 | NYDGR 1198 | DQGYSKFYFD 1199 | SEDIYNR 1200 | GAT 1201 | YWSFPR 1202 |
| 37 | CD8B319 | GYSFTAY 1231 | NPSAGG 1232 | WTNPFD 1233 | SQNVGTA 1234 | SAS 1235 | YNNYL 1236 |
| 38 | CD8B194 | GYTFTSY 1265 | YPGSSS 1266 | ELGPYYRYSAMV 1267 | SQNVGTA 1268 | SAS 1269 | YSSYPF 1270 |
| 39 | CD8B231 | GYTFTNY 1299 | DPSDSE 1300 | GLTGTGH 1301 | SQDINIY 1302 | HTS 1303 | DNTLPY 1304 |
| 40 | CD8B238 | GYTFTDY 1333 | YTYSGG 1334 | DSSDYEFA 1335 | SQDIKSY 1336 | RAN 1337 | YDEFR 1338 |
| 41 | CD8B255 | GFSLNTSGM 1367 | FWDDD 1368 | RDGYGDYAYFD 1369 | SENIYSD 1370 | AAT 1371 | FWGTPW 1372 |
| 42 | CD8B324 | GYTSTSH 1401 | YPGSSS 1402 | HS PGHRDYAMD 1403 | SQNVGTA 1404 | SAS 1405 | YSTYPL 1406 |
| 43 | CD8B337 | GFSLSTSGM 1435 | FWDDD 1436 | RVGYGDYAYFD 1437 | SENIYSD 1438 | AAT 1439 | FWGTPW 1440 |
| 44 | CD8B344 | GYSFTNY 1469 | YPGSDS 1470 | EEADYRYTWFV 1471 | SQNVGTA 1472 | SAS 1473 | YSSYPL 1474 |

TABLE 4-continued

Chothia CDR Amino Acid Sequences of CD8 Antibodies

| # | Protein Name | HC Chothia CDR1 | HC Chothia CDR2 | HC Chothia CDR3 | LC Chothia CDR1 | LC Chothia CDR2 | LC Chothia CDR3 |
|---|---|---|---|---|---|---|---|
| 45 | CD8B264 | GYSFTSY 1503 | YPGSSS 1504 | EEYSYKSSWFA 1505 | SQNVGTA 1506 | SAS 1507 | YSTYPY 1508 |
| 46 | CD8B318 | GYTFTSY 1537 | YPGSSS 1538 | EEYSYFPSWFA 1539 | SQNVGTA 1540 | SAS 1541 | YSTYPF 1542 |
| 47 | CD8B333 | GYSFASF 1571 | YPGSSS 1572 | EEYSYKSSWFA 1573 | SQNVGTA 1574 | SAS 1575 | YSTYPY 1576 |
| 48 | CD8B366 | GFNIKDD 1605 | DPANGN 1606 | DDEGYYYFD 1607 | SKSISKY 1608 | SGS 1609 | HNEYPL 1610 |
| 49 | CD8B368 | GYTFTSY 1639 | YPFSSS 1640 | EEFSHYPSWFA 1641 | SQNVGIA 1642 | SAS 1643 | YSTDPY 1644 |
| 50 | CD8B370 | GYTFTSY 1673 | YPGSSS 1674 | ELGAYYHYSAMD 1675 | SQNVGTA 1676 | SAS 1677 | YSIYPF 1678 |
| 51 | CD8B186 | GYIFTSY 1707 | NPSSGY 1708 | RVFYGDSWFA 1709 | SGNIHNY 1710 | NAK 1711 | FWSTTW 1712 |
| 52 | CD8B190 | GYSFTSY 1741 | DPFNGN 1742 | PNSNYVGTWFA 1743 | SQNINVW 1744 | KAS 1745 | GQSFPF 1746 |
| 53 | CD8B192 | GYTFTDY 1775 | NPYNGG 1776 | NYGAMD 1777 | SGNIHNY 1778 | NAK 1779 | FWITPP 1780 |
| 54 | CD8B193 | GYKFTDY 1809 | NPNGGG 1810 | TSGTDWYFD 1811 | SQNVGTA 1812 | SAS 1813 | YSSYPF 1814 |
| 55 | CD8B214 | GYTFTTA 1843 | NTHAGE 1844 | SGDYDGSHPFA 1845 | SQDIRPY 1846 | YTS 1847 | DNTLPY 1848 |
| 56 | CD8B230 | GYTFTDY 1877 | NPNGGG 1878 | TSGTDWYFD 1879 | SQNVGTA 1880 | STS 1881 | YSIYPF 1882 |
| 57 | CD8B245 | GFTFTDY 1911 | RNKGNGYT 1912 | TVTGTLFYYALD 1913 | SENIYSY 1914 | NAK 1915 | HYGTPL 1916 |
| 58 | CD8B248 | GYTFTTY 1945 | NPSSGY 1946 | LWA 1947 | SQSLVHSSGNTY 1948 | KGS 1949 | STHVPF 1950 |
| 59 | CD8B250 | GFSLSNY 1979 | WTDGS 1980 | NNGYFPAFFA 1981 | SQNVDTD 1982 | SAS 1983 | YNSYPL 1984 |
| 60 | CD8B254 | GYTFSSY 2013 | YPGSGS 2014 | ESITTRITPFD 2015 | SQSLVHSSGNTY 2016 | KGS 2017 | STHVPF 2018 |
| 61 | CD8B261 | GYTFNSY 2047 | YPGSSS 2048 | ELGGYYRYNAMD 2049 | SQDINRY 2050 | RAN 2051 | YDEFPY 2052 |
| 62 | CD8B311 | GYTFTSY 2081 | HPNSGS 2082 | CGYDGAWFA 2083 | SQGISNC 2084 | YTS 2085 | YSKVPY 2086 |
| 63 | CD8B340 | GYTFTNY 2115 | DPSDTF 2116 | GDWDRDWYFD 2117 | SQSLLYSDGKTY 2118 | LVS 2119 | ATHFPH 2120 |
| 64 | CD8B362 | GFNIKDT 2149 | DPANGH 2150 | RFA 2151 | SHEISGY 2152 | AAS 2153 | YSSYPY 2154 |

TABLE 5

AbM CDR Amino Acid Sequences of CD8 Antibodies

| # | Protein Name | HC AbM CDR1 | HC AbM CDR2 | HC AbM CDR3 | LC AbM CDR1 | LC AbM CDR2 | LC AbM CDR3 |
|---|---|---|---|---|---|---|---|
| 1 | CD8B191 | GYTFTDYYMN 13 | RVIPSNGGTI 14 | EDYNNQGFFLDAMDYRASQSISDFLH 15 | 16 | YASQSIS 17 | QNGHSFPYT 18 |

TABLE 5-continued

AbM CDR Amino Acid Sequences of CD8 Antibodies

| # | Protein Name | HC AbM CDR1 | HC AbM CDR2 | HC AbM CDR3 | LC AbM CDR1 | LC AbM CDR2 | LC AbM CDR3 |
|---|---|---|---|---|---|---|---|
| 2 | CD8B226 | GYTFTDYYMN 47 | RIIPSNGATI 48 | EDYSNQGFFLDAMDY 49 | RASQSISHYLH 50 | YASQSIS 51 | QNGHSFPYT 52 |
| 3 | CD8B259 | GYTFTDYYMN 81 | RVIPSNGGTI 82 | EDYGNQGFFLDAMDY 83 | RASQSISHFLH 84 | YASQSIS 85 | QSGHSFPYT 86 |
| 4 | CD8B298 | GYTFTDYYMN 115 | RVIPNNGGTR 116 | EDFSNQGFFLDAMDY 117 | RASQTISDYLH 118 | YASQSIS 119 | QNGHSFPYT 120 |
| 5 | CD8B342 | GYTFTDYYVN 149 | RVIPNNGNVI 150 | EDYSNQGFFLDAMDY 151 | RASQTISNYLH 152 | YASQSIS 153 | QNGHSFPYT 154 |
| 6 | CD8B364 | GYTFTSYWMH 183 | EINPSNGDSY 184 | SMYYDGRAGAY 185 | ITSTDIDDDMN 186 | EGNTLRP 187 | LQSDNMPLT 188 |
| 7 | CD8B200 | GYTFTNYWIH 217 | NIDPSDSETH 218 | GLTGTGYY 219 | RASQDISPYLN 220 | YTSKLHS 221 | QQDNTLPYT 222 |
| 8 | CD8B247 | GYTFTDYYMN 251 | RVIPNNGGTI 252 | EDYSNQGFFLDAMDY 253 | RASQTISHFLH 254 | YASQSIS 255 | QSGHSFPYT 256 |
| 9 | CD8B265 | GYSFTDYYMN 285 | RVIPRNGATT 286 | EDFSNQGFFLDAMDY 287 | RASQSISHYLH 288 | YASQSIS 289 | QNGHSFPYT 290 |
| 10 | CD8B270 | GYTFTNYWMH 319 | NIDPSDSETH 320 | GLTGTGYY 321 | RASQDIRPYLN 322 | FTSKLHS 323 | QQDNTLPYT 324 |
| 11 | CD8B213 | GYIFTDYYMD 353 | YIYPNNGITS 354 | SIYYDHGGGFPY 355 | KASQNVDKYVA 356 | SASYRYS 357 | QQYNTYPS 358 |
| 12 | CD8B240 | GYTFTDYYMN 387 | RVIPSNGGTI 388 | EDYNNQGFFLDAMDY 389 | RASQSISDFLH 390 | YASQSIS 391 | QNGHSFPYT 392 |
| 13 | CD8B361 | GYTFTDYYMD 421 | YIYPNNGDTR 422 | SIYYDHGGGFPY 423 | KASQNVGTYVA 424 | SASYRYS 425 | QQYNSYPT 426 |
| 14 | CD8B246 | GFSLSTSGMNVG 455 | HIWWDDDKY 456 | RGNYGNYEFAY 457 | RASQDIRNYLN 458 | HTSRLHS 459 | QQGNTLPWT 460 |
| 15 | CD8B268 | GYTFTVYTIH 489 | WFYPGSGNIK 490 | HEDNHYYDGNSWFAY 491 | RASGNIHNYLA 492 | NAKTLAD 493 | QHFWNTPYT 494 |
| 16 | CD8B271 | GFSLSIYSIH 523 | MIWGGGDTD 524 | NPHYYGGTYEYFDV 525 | SASQGISNYLN 526 | DTSILYS 527 | QQYSNLPYT 528 |
| 17 | CD8B273 | GYTFTEYTIH 557 | WFYPGTGSIK 558 | HEDNHYYDGNSWFAY 559 | RASGNIHNYLA 560 | NAKTLAD 561 | QHFWSTPYT 562 |
| 18 | CD8B288 | GYTFTEYTIH 591 | WFYPGNGNMR 592 | YEDNHYYDGASWFAY 593 | RASGNIHNYLA 594 | NAKTLAD 595 | QHFWSTPFT 596 |
| 19 | CD8B292 | GFNFKDDYIY 625 | WIDPENGATE 626 | HDYGYAMDY 627 | TASSSVSSSYLH 628 | STSNLAS 629 | HQYHRSPLT 630 |
| 20 | CD8B303 | GFSLSTYSTH 659 | MIWGGGSTD 660 | NPHHYGGSTGAMDY 661 | KASQDIKKYMA 662 | YTSSLQP 663 | LQYDNLFT 664 |
| 21 | CD8B304 | GFSLSTSGMNVG 693 | HIWWDDDKY 694 | RGNYGNYEFAY 695 | RASQDIRNYLN 696 | HTSRLHS 697 | QQGNTLPWT 698 |
| 22 | CD8B312 | GYTFTSFWMH 727 | NVDPSDSQTH 728 | STYYRYDGPFTY 729 | RASQSINNLH 730 | YTSQSIS 731 | QQSNSWPLT 732 |
| 23 | CD8B347 | GYTFTSYWMN 761 | AVNPSNSYTE 762 | SGLYNTNHLAWFAY 763 | RASGNIHNYLA 764 | NAETLAD 765 | QHFWNNPLT 766 |
| 24 | CD8B350 | GYTFAAYWIN 795 | SINPSNGYTE 796 | SGLYYTNHLAWCPY 797 | RASGNIHNYLA 798 | NAETLAD 799 | QHFWNSPLT 800 |
| 25 | CD8B356 | GYSITSGYYWNYI 829 | SYDGSNN 830 | NHGDAMDY 831 | KASQNVGTAVA 832 | SASYRYT 833 | QQYSSYLT 834 |
| 26 | CD8B369 | GFTFTNTYIS 863 | WIYTGTGGTW 864 | TNWDWYFDV 865 | RASENIYSYLA 866 | YAKTLTD 867 | QHHYGRPYT 868 |

TABLE 5-continued

AbM CDR Amino Acid Sequences of CD8 Antibodies

| # | Protein Name | HC AbM CDR1 | HC AbM CDR2 | HC AbM CDR3 | LC AbM CDR1 | LC AbM CDR2 | LC AbM CDR3 |
|---|---|---|---|---|---|---|---|
| 27 | CD8B371 | GFTFSDYYMA 897 | HINYDGSITY 898 | EDYSNYGFAY 899 | HASQNINVWLS 900 | KASNLHT 901 | QQGQSYPLT 902 |
| 28 | CD8B182 | GYTFTSYWMN 931 | AVNPTNYYTE 932 | SGLYNTNHLAWFAY 933 | RASENIHNYLA 934 | NAKTLAN 935 | QHFWTTPLT 936 |
| 29 | CD8B205 | GYSFNSYWMH 965 | NIDPSDSETH 966 | VYYSYYSYDATYFDY 967 | RASENIYSYLA 968 | NAKTLAE 969 | QHHYTTPLT 970 |
| 30 | CD8B223 | GFSLTSYSVH 999 | VIWAGGSTN 1000 | HSYYSFDAFDY 1001 | KASQNVNTDVA 1002 | SASYRYS 1003 | QQCNSYPLT 1004 |
| 31 | CD8B234 | GYSITSGYYWN 1033 | YINYDGRNN 1034 | DQGYSKFYFDY 1035 | KASEDIYNRLA 1036 | GATSLET 1037 | QQWSFPRT 1038 |
| 32 | CD8B251 | GFSLTTYAVH 1067 | VIWSGGSTD 1068 | HSYYHYNAMDN 1069 | KASQNVGTAVA 1070 | SASNRYT 1071 | QQYSSYPFT 1072 |
| 33 | CD8B269 | GYSITSGYYWN 1101 | YISYDGSNN 1102 | NHGDAMDH 1103 | KASQNVGTDVA 1104 | SASYRYS 1105 | QQYKSYPLT 1106 |
| 34 | CD8B290 | GFSLSRYSVH 1135 | MIWGGGSTD 1136 | IYFDNYVGFAY 1137 | KASQDVGTVVA 1138 | WTSTRHT 1139 | QQYSSYPYT 1140 |
| 35 | CD8B310 | GFSLTNYAVH 1169 | VIWTDGSTD 1170 | NNGYFPAFFAY 1171 | RSSQTIVHSNGNTYLE 1172 | KVSNRFS 1173 | FQGSHAPFT 1174 |
| 36 | CD8B352 | GYSITSGYYWN 1203 | YINYDGRNN 1204 | DQGYSKFYFDY 1205 | KASEDIYNRLA 1206 | GATSLET 1207 | QQWSFPRT 1208 |
| 37 | CD8B319 | GYSFTAYYMH 1237 | EINPSAGGTT 1238 | WTNPFDY 1239 | KASQNVGTAVA 1240 | SASYRYT 1241 | QQYNNYLT 1242 |
| 38 | CD8B194 | GYTFTSYWIN 1271 | NIYPGSSSTN 1272 | ELGPYYRYSAMVY 1273 | KASQNVGTAVA 1274 | SASNRYT 1275 | QQYSSYPFT 1276 |
| 39 | CD8B231 | GYTFTNYWMH 1305 | NIDPSDSETH 1306 | GLTGTGHY 1307 | RASQDINIYLN 1308 | HTSRLHS 1309 | QQDNTLPYT 1310 |
| 40 | CD8B238 | GYTFTDYSMD 1339 | YIYTYSGGAG 1340 | DSSDYEFAY 1341 | KASQDIKSYLS 1342 | RANRLVD 1343 | LQYDEFRT 1344 |
| 41 | CD8B255 | GFSLNTSGMGVS 1373 | HIFWDDDKR 1374 | RDGYGDYAYFDV 1375 | RASENIYSDLA 1376 | AATILTD 1377 | QHFWGTPWT 1378 |
| 42 | CD8B324 | GYTSTSHWIH 1407 | NIYPGSSSTN 1408 | HSPGHRDYAMDY 1409 | KASQNVGTAVA 1410 | SASNRYT 1411 | QQYSTYPLT 1412 |
| 43 | CD8B337 | GFSLSTSGMGVS 1441 | HIFWDDDRR 1442 | RVGYGDYAYFDV 1443 | RASENIYSDLA 1444 | AATNLAD 1445 | QHFWGTPWT 1446 |
| 44 | CD8B344 | GYSFTNYWIN 1475 | NIYPGSDSSN 1476 | EEADYRYTWFVY 1477 | KASQNVGTAVA 1478 | SASNRYT 1479 | QQYSSYPLT 1480 |
| 45 | CD8B264 | GYSFTSYWIN 1509 | NIYPGSSSTN 1510 | EEYSYKSSWFAY 1511 | KASQNVGTAVA 1512 | SASNRYN 1513 | QQYSTYPYT 1514 |
| 46 | CD8B318 | GYTFTSYWIS 1543 | NIYPGSSSSN 1544 | EEYSYFPSWFAY 1545 | KASQNVGTAVA 1546 | SASNRYT 1547 | QQYSTYPFT 1548 |
| 47 | CD8B333 | GYSFASFWIN 1577 | NIYPGSSSTN 1578 | EEYSYKSSWFAY 1579 | KASQNVGTAVA 1580 | SASNRYN 1581 | QQYSTYPYT 1582 |
| 48 | CD8B366 | GFNIKDDYIH 1611 | RIDPANGNPR 1612 | DDEGYYYFDV 1613 | RASKSISKYLA 1614 | SGSTLQS 1615 | QQHNEYPLT 1616 |
| 49 | CD8B368 | GYTFTSYWIN 1645 | NIYPFSSSTN 1646 | EEFSHYPSWFAY 1647 | KASQNVGIAVA 1648 | SASNRYT 1649 | QQYSTDPYT 1650 |
| 50 | CD8B370 | GYTFTSYWIN 1679 | NIYPGSSSTN 1680 | ELGAYYHYSAMDY 1681 | KASQNVGTAVA 1682 | SASNRYT 1683 | QQYSIYPFT 1684 |
| 51 | CD8B186 | GYIFTSYWMH 1713 | NINPSSGYAV 1714 | RVFYGDSWFAY 1715 | RASGNIHNYLA 1716 | NAKTLAD 1717 | QHFWSTTWT 1718 |

TABLE 5-continued

AbM CDR Amino Acid Sequences of CD8 Antibodies

| # | Protein Name | HC AbM CDR1 | HC AbM CDR2 | HC AbM CDR3 | LC AbM CDR1 | LC AbM CDR2 | LC AbM CDR3 |
|---|---|---|---|---|---|---|---|
| 52 | CD8B190 | GYSFTSYYMH 1747 | YIDPFNGNTN 1748 | PNSNYVGTWFAY 1749 | HASQNINVWLS 1750 | KASNLHT 1751 | QQGQSFPFT 1752 |
| 53 | CD8B192 | GYTFTDYYMN 1781 | VINPYNGGTT 1782 | NYGAMDS 1783 | RASGNIHNYLA 1784 | NAKTLAD 1785 | QHFWITPPT 1786 |
| 54 | CD8B193 | GYKFTDYYMN 1815 | DINPNGGGTS 1816 | TSGTDWYFDV 1817 | KASQNVGTAVA 1818 | SASNRYT 1819 | QQYSSYPFT 1820 |
| 55 | CD8B214 | GYTFTTAGIQ 1849 | WINTHAGESK 1850 | SGDYDGSHPFAY 1851 | RASQDIRPYLN 1852 | YTSRLHS 1853 | QQDNTLPYT 1854 |
| 56 | CD8B230 | GYTFTDYYMN 1883 | DINPNGGGTS 1884 | TSGTDWYFDV 1885 | KASQNVGTAVA 1886 | STSNRYT 1887 | QQYSIYPFT 1888 |
| 57 | CD8B245 | GFTFTDYYMS 1917 | LSRNKGNGYTTE 1918 | VTGTLFYYALDY 1919 | RASENIYSYLA 1920 | NAKTLAA 1921 | QHHYGTPLT 1922 |
| 58 | CD8B248 | GYTFTTYTMH 1951 | YINPSSGYTK 1952 | LWAY 1953 | RSSQSLVHSSGNTYLH 1954 | KGSNRFS 1955 | SQSTHVPFT 1956 |
| 59 | CD8B250 | GFSLSNYVVH 1985 | VIWTDGSTD 1986 | NNGYFPAFFAY 1987 | KASQNVDTDIT 1988 | SASYRYS 1989 | QQYNSYPLT 1990 |
| 60 | CD8B254 | GYTFSSYWIT 2019 | DIYPGSGSTN 2020 | ESITTRITPFDH 2021 | RSSQSLVHSSGNTYLH 2022 | KGSNRFS 2023 | SQSTHVPFT 2024 |
| 61 | CD8B261 | GYTFNSYWIN 2053 | NIYPGSSSTN 2054 | ELGGYYRYNAMDY 2055 | KASQDINRYLS 2056 | RANTLVD 2057 | LQYDEFPYT 2058 |
| 62 | CD8B311 | GYTFTSYWMH 2087 | MIHPNSGSTN 2088 | CGYDGAWFAY 2089 | SASQGISNCLN 2090 | YTSSLHS 2091 | QQYSKVPYT 2092 |
| 63 | CD8B340 | GYTFTNYWMQ 2121 | EIDPSDTFTN 2122 | GDWDRDWYFDV 2123 | KSSQSLLYSDGKTYLN 2124 | LVSKLDS 2125 | LQATHFPHT 2126 |
| 64 | CD8B362 | GFNIKDTYMH 2155 | RIDPANGHTK 2156 | RFAY 2157 | RASHEISGYLS 2158 | AASTLDS 2159 | LQYSSYPYT 2160 |

TABLE 6

Contact CDR Amino Acid Sequences of CD8 Antibodies

| # | Protein Name | HC Contact CDR1 | HC Contact CDR2 | HC Contact CDR3 | LC Contact CDR1 | LC Contact CDR2 | LC Contact CDR3 |
|---|---|---|---|---|---|---|---|
| 1 | CD8B191 | TDYYMN 19 | WIGRVIPSNGGTI 20 | AREDYNNQGFFLDAMD 21 | SDFLHWY 22 | LLIKYASQSI 23 | QNGHSFPY 24 |
| 2 | CD8B226 | TDYYMN 53 | WIGRIIPSNGATI 54 | AREDYSNQGFFLDAMD 55 | SHYLHWY 56 | LLIKYASQSI 57 | QNGHSFPY 58 |
| 3 | CD8B259 | TDYYMN 87 | WIGRVIPSNGGTI 88 | AREDYGNQGFFLDAMD 89 | SHFLHWY 90 | LLIKYASQSI 91 | QSGHSFPY 92 |
| 4 | CD8B298 | TDYYMN 121 | WIGRVIPNNGGTR 122 | AREDFSNQGFFLDAMD 123 | SDYLHWY 124 | LLIKYASQSI 125 | QNGHSFPY 126 |
| 5 | CD8B342 | TDYYVN 155 | WIGRVIPNNGNVI 156 | TREDYSNQGFFLDAMD 157 | SNYLHWY 158 | LLIKYASQSI 159 | QNGHSFPY 160 |
| 6 | CD8B364 | TSYWMH 189 | WIGEINPSNGDSY 190 | TRSMYYDGRAGA 191 | DDDMNWY 192 | LLISEGNTLR 193 | LQSDNMPL 194 |
| 7 | CD8B200 | TNYWIH 223 | WIGNIDPSDSETH 224 | ASGLTGTGY 225 | SPYLNWY 226 | LLIYYTSKLH 227 | QQDNTLPY 228 |
| 8 | CD8B247 | TDYYMN 257 | WIGRVIPNNGGTI 258 | AREDYSNQGFFLDAMD 259 | SHFLHWY 260 | LLIKYASQSI 261 | QSGHSFPY 262 |

TABLE 6-continued

Contact CDR Amino Acid Sequences of CD8 Antibodies

| Protein # Name | HC Contact CDR1 | HC Contact CDR2 | HC Contact CDR3 | LC Contact CDR1 | LC Contact CDR2 | LC Contact CDR3 |
|---|---|---|---|---|---|---|
| 9 CD8B265 | TDYYMN 291 | WIGRVIPRNGATT 292 | AREDFSNQGFFLDAMD 293 | SHYLHWY 294 | LLIKYASQSI 295 | QNGHSFPY 296 |
| 10 CD8B270 | TNYWMH 325 | WIGNIDPSDSETH 326 | ASGLTGTGY 327 | RPYLNWY 328 | LLIYFTSKLH 329 | QQDNTLPY 330 |
| 11 CD8B213 | TDYYMD 359 | WIGYIYPNNGITS 360 | ARSIYYDHGGGFP 361 | DKYVAWY 362 | ALIYSASYRY 363 | QQYNTYP 364 |
| 12 CD8B240 | TDYYMN 393 | WIGRVIPSNGGTI 394 | AREDYNNQGFFLDAMD 395 | SDFLHWY 396 | LLIKYASQSI 397 | QNGHSFPY 398 |
| 13 CD8B361 | TDYYMD 427 | WIGYIYPNNGDTR 428 | ARSIYYDHGGGFP 429 | GTYVAWY 430 | ALIYSASYRY 431 | QQYNSYP 432 |
| 14 CD8B246 | STSGMNVG 461 | WLAHIWWDDDKY 462 | ARRGNYGNYEFA 463 | RNYLNWY 464 | LLIYHTSRLH 465 | QQGNTLPW 466 |
| 15 CD8B268 | TVYTIH 495 | WIGWFYPGSGNIK 496 | ARHEDNHYYDGNSWFA 497 | HNYLAWF 498 | LLVYNAKTLA 499 | QHFWNTPY 500 |
| 16 CD8B271 | SIYSIH 529 | WLGMIWGGGDTD 530 | ARNPHYYGGTYEYFD 531 | SNYLNWY 532 | LLIYDTSILY 533 | QQYSNLPY 534 |
| 17 CD8B273 | TEYTIH 563 | WIGWFYPGTGSIK 564 | ARHEDNHYYDGNSWFA 565 | HNYLAWF 566 | LLVYNAKTLA 567 | QHFWSTPY 568 |
| 18 CD8B288 | TEYTIH 597 | WIGWFYPGNGNMR 598 | ARYEDNHYYDGASWFA 599 | HNYLAWF 600 | LLVYNAKTLA 601 | QHFWSTPF 602 |
| 19 CD8B292 | KDDYIY 631 | WIGWIDPENGATE 632 | SLHDYGYAMD 633 | SSSYLHWY 634 | LWIYSTSNLA 635 | HQYHRSPL 636 |
| 20 CD8B303 | STYSTH 665 | WLGMIWGGGSTD 666 | ARNPHHYGGSTGAMD 667 | KKYMAWY 668 | LLIHYTSSLQ 669 | LQYDNLF 670 |
| 21 CD8B304 | STSGMNVG 699 | WLAHIWWDDDKY 700 | ARRGNYGNYEFA 701 | RNYLNWY 702 | LLIYHTSRLH 703 | QQGNTLPW 704 |
| 22 CD8B312 | TSFWMH 733 | WIGNVDPSDSQTH 734 | ARSTYYRYDGPFT 735 | NNNLHWY 736 | LLIKYTSQSI 737 | QQSNSWPL 738 |
| 23 CD8B347 | TSYWMN 767 | WIGAVNPSNSYTE 768 | ARSGLYNTNHLAWFA 769 | HNYLAWY 770 | LLVFNAETLA 771 | QHFWNNPL 772 |
| 24 CD8B350 | AAYWIN 801 | WIGSINPSNGYTE 802 | SRSGLYYTNHLAWCP 803 | HNYLAWY 804 | VLVYNAETLA 805 | QHFWNSPL 806 |
| 25 CD8B356 | TSGYYWN 835 | WMGYISYDGSNN 836 | VRNHGDAMD 837 | GTAVAWY 838 | LLIYSASYRY 839 | QQYSSYL 840 |
| 26 CD8B369 | TNTYIS 869 | WIAWIYTGTGGTW 870 | ARTNWDWYFD 871 | YSYLAWY 872 | LLVYYAKTLT 873 | QHHYGRPY 874 |
| 27 CD8B371 | SDYYMA 903 | WVAHINYDGSITY 904 | AREDYSNYGFA 905 | NVWLSWY 906 | LLIYKASNLH 907 | QQGQSYPL 908 |
| 28 CD8B182 | TSYWMN 937 | WIGAVNPTNYYTE 938 | ARSGLYNTNHLAWFA 939 | HNYLAWY 940 | LLVYNAKTLA 941 | QHFWTTPL 942 |
| 29 CD8B205 | NSYWMH 971 | WIGNIDPSDSETH 972 | ARVYYSYYSYDATYFD 973 | YSYLAWY 974 | LLVYNAKTLA 975 | QHHYTTPL 976 |
| 30 CD8B223 | TSYSVH 1005 | WLGVIWAGGSTN 1006 | AKHSYYSFDAFD 1007 | NTDVAWY 1008 | ALIYSASYRY 1009 | QQCNSYPL 1010 |
| 31 CD8B234 | TSGYYWN 1039 | WMGYINYDGRNN 1040 | SRDQGYSKFYFD 1041 | YNRLAWY 1042 | LLISGATSLE 1043 | QQWSFPR 1044 |
| 32 CD8B251 | TTYAVH 1073 | WLGVIWSGGSTD 1074 | ARHSYYHYNAMD 1075 | GTAVAWY 1076 | LLIYSASNRY 1077 | QQYSSYPF 1078 |
| 33 CD8B269 | TSGYYWN 1107 | WMGYISYDGSNN 1108 | VRNHGDAMD 1109 | GTDVAWY 1110 | ALIYSASYRY 1111 | QQYKSYPL 1112 |

TABLE 6-continued

Contact CDR Amino Acid Sequences of CD8 Antibodies

| Protein # Name | HC Contact CDR1 | HC Contact CDR2 | HC Contact CDR3 | LC Contact CDR1 | LC Contact CDR2 | LC Contact CDR3 |
|---|---|---|---|---|---|---|
| 34 CD8B290 | SRYSVH 1141 | WLGMIWGGGSTD 1142 | ARIYFDNYVGFA 1143 | GTVVAWY 1144 | LLIFWTSTRH 1145 | QQYSSYPY 1146 |
| 35 CD8B310 | TNYAVH 1175 | WLGVIWTDGSTD 1176 | ARNNGYFPAFFA 1177 | VHSNGNTYLEWY 1178 | LLMYKVSNRF 1179 | FQGSHAPF 1180 |
| 36 CD8B352 | TSGYYWN 1209 | WMGYINYDGRNN 1210 | ARDQGYSKFYFD 1211 | YNRLAWY 1212 | LLISGATSLE 1213 | QQWSFPR 1214 |
| 37 CD8B319 | TAYYMH 1243 | WIGEINPSAGGTT 1244 | ARWTNPFD 1245 | GTAVAWY 1246 | LLIYSASYRY 1247 | QQYNNYL 1248 |
| 38 CD8B194 | TSYWIN 1277 | WIGNIYPGSSSTN 1278 | ARELGPYYRYSAMV 1279 | GTAVAWY 1280 | LLIYSASNRY 1281 | QQYSSYPF 1282 |
| 39 CD8B231 | TNYWMH 1311 | WIGNIDPSDSETH 1312 | ASGLTGTGH 1313 | NIYLNWY 1314 | CLIYHTSRLH 1315 | QQDNTLPY 1316 |
| 40 CD8B238 | TDYSMD 1345 | WIGYIYTYSGGAG 1346 | ARDSSDYEFA 1347 | KSYLSWF 1348 | TLIYRANRLV 1349 | LQYDEFR 1350 |
| 41 CD8B255 | NTSGMGVS 1379 | WLAHIFWDDDKR 1380 | ARRDGYGDYAYFD 1381 | YSDLAWY 1382 | LLVYAATILT 1383 | QHFWGTPW 1384 |
| 42 CD8B324 | TSHWIH 1413 | WIGNIYPGSSSTN 1414 | ARHSPGHRDYAMD 1415 | GTAVAWY 1416 | LLIASASNRY 1417 | QQYSTYPL 1418 |
| 43 CD8B337 | STSGMGVS 1447 | WLAHIFWDDDRR 1448 | ARRVGYGDYAYFD 1449 | YSDLAWY 1450 | LLVYAATNLA 1451 | QHFWGTPW 1452 |
| 44 CD8B344 | TNYWIN 1481 | WIGNIYPGSDSSN 1482 | AREEADYRYTWFV 1483 | GTAVAWY 1484 | LLIYSASNRY 1485 | QQYSSYPL 1486 |
| 45 CD8B264 | TSYWIN 1515 | WIGNIYPGSSSTN 1516 | AREEYSYKSSWFA 1517 | GTAVAWY 1518 | LLIYSASNRY 1519 | QQYSTYPY 1520 |
| 46 CD8B318 | TSYWIS 1549 | WIGNIYPGSSSSN 1550 | AREEYSYFPSWFA 1551 | GTAVAWF 1552 | LLIYSASNRY 1553 | QQYSTYPF 1554 |
| 47 CD8B333 | ASFWIN 1583 | WIGNIYPGSSSTN 1584 | AREEYSYKSSWFA 1585 | GTAVAWY 1586 | LLIYSASNRY 1587 | QQYSTYPY 1588 |
| 48 CD8B366 | KDDYIH 1617 | WIGRIDPANGNPR 1618 | ARDDEGYYYFD 1619 | SKYLAWY 1620 | VLIYSGSTLQ 1621 | QQHNEYPL 1622 |
| 49 CD8B368 | TSYWIN 1651 | WIGNIYPFSSSTN 1652 | AREEFSHYPSWFA 1653 | GIAVAWF 1654 | LLIYSASNRY 1655 | QQYSTDPY 1656 |
| 50 CD8B370 | TSYWIN 1685 | WIGNIYPGSSSTN 1686 | TRELGAYYHYSAMD 1687 | GTAVAWY 1688 | LLIYSASNRY 1689 | QQYSIYPF 1690 |
| 51 CD8B186 | TSYWMH 1719 | WIGNINPSSGYAV 1720 | ARRVFYGDSWFA 1721 | HNYLAWY 1722 | LLVYNAKTLA 1723 | QHFWSTTW 1724 |
| 52 CD8B190 | TSYYMH 1753 | WIGYIDPFNGNTN 1754 | ASPNSNYVGTWFA 1755 | NVWLSWY 1756 | LLIYKASNLH 1757 | QQGQSFPF 1758 |
| 53 CD8B192 | TDYYMN 1787 | WIGVINPYNGGTT 1788 | ARNYGAMD 1789 | HNYLAWY 1790 | LLVSNAKTLA 1791 | QHFWITPP 1792 |
| 54 CD8B193 | TDYYMN 1821 | WIGDINPNGGGTS 1822 | ARTSGTDWYFD 1823 | GTAVAWY 1824 | LLIYSASNRY 1825 | QQYSSYPF 1826 |
| 55 CD8B214 | TTAGIQ 1855 | WIGWINTHAGESK 1856 | ARSGDYDGSHPFA 1857 | RPYLNWY 1858 | LLIYYTSRLH 1859 | QQDNTLPY 1860 |
| 56 CD8B230 | TDYYMN 1889 | WIGDINPNGGGTS 1890 | ARTSGTDWYFD 1891 | GTAVAWY 1892 | LLIYSTSNRY 1893 | QQYSIYPF 1894 |
| 57 CD8B245 | TDYYMS 1923 | WLALSRNKGNGYTTEARTVTGTLFYYALD 1924 1925 | | YSYLAWY 1926 | FLVYNAKTLA 1927 | QHHYGTPL 1928 |

TABLE 6-continued

Contact CDR Amino Acid Sequences of CD8 Antibodies

| Protein # Name | HC Contact CDR1 | HC Contact CDR2 | HC Contact CDR3 | LC Contact CDR1 | LC Contact CDR2 | LC Contact CDR3 |
|---|---|---|---|---|---|---|
| 58 CD8B248 | TTYTMH 1957 | WIGYINPSSGYTK 1958 | ARLWA 1959 | VHSSGNTYLHWY 1960 | LLIYKGSNRF 1961 | SQSTHVPF 1962 |
| 59 CD8B250 | SNYVVH 1991 | WLGVIWTDGSTD 1992 | ARNNGYFPAFFA 1993 | DTDITWY 1994 | ALIYSASYRY 1995 | QQYNSYPL 1996 |
| 60 CD8B254 | SSYWIT 2025 | WVGDIYPGSGSTN 2026 | ARESITTRITPFD 2027 | VHSSGNTYLHWY 2028 | LLIYKGSNRF 2029 | SQSTHVPF 2030 |
| 61 CD8B261 | NSYWIN 2059 | WIGNIYPGSSSTN 2060 | ARELGGYYRYNAMD 2061 | NRYLSWF 2062 | TLIYRANTLV 2063 | LQYDEFPY 2064 |
| 62 CD8B311 | TSYWMH 2093 | WIGMIHPNSGSTN 2094 | ARCGYDGAWFA 2095 | SNCLNWY 2096 | LLIHYTSSLH 2097 | QQYSKVPY 2098 |
| 63 CD8B340 | TNYWMQ 2127 | WIGEIDPSDTFTN 2128 | ARGDWDRDWYFD 2129 | LYSDGKTYLNWL 2130 | LLIYLVSKLD 2131 | LQATHFPH 2132 |
| 64 CD8B362 | KDTYMH 2161 | WIGRIDPANGHTK 2162 | AIRFA 2163 | SGYLSWL 2164 | RLIYAASTLD 2165 | LQYSSYPY 2166 |

TABLE 7

IMGT CDR Amino Acid Sequences of CD8 Antibodies

| Protein # Name | HC IMGT CDR1 | HC IMGT CDR2 | HC IMGT CDR3 | LC IMGT CDR1 | LC IMGT CDR2 | LC IMGT CDR3 |
|---|---|---|---|---|---|---|
| 1 CD8B191 | GYTFTDYY 25 | VIPSNGGT 26 | AREDYNNQGFFLDAMDY 27 | QSISDF 28 | YAS 29 | QNGHSFPYT 30 |
| 2 CD8B226 | GYTFTDYY 59 | IIPSNGAT 60 | AREDYSNQGFFLDAMDY 61 | QSISHY 62 | YAS 63 | QNGHSFPYT 64 |
| 3 CD8B259 | GYTFTDYY 93 | VIPSNGGT 94 | AREDYGNQGFFLDAMDY 95 | QSISHF 96 | YAS 97 | QSGHSFPYT 98 |
| 4 CD8B298 | GYTFTDYY 127 | VIPNNGGT 128 | AREDFSNQGFFLDAMDY 129 | QTISDY 130 | YAS 131 | QNGHSFPYT 132 |
| 5 CD8B342 | GYTFTDYY 161 | VIPNNGNV 162 | TREDYSNQGFFLDAMDY 163 | QTISNY 164 | YAS 165 | QNGHSFPYT 166 |
| 6 CD8B364 | GYTFTSYW 195 | INPSNGDS 196 | TRSMYYDGRAGAY 197 | TDIDDD 198 | EGN 199 | LQSDNMPLT 200 |
| 7 CD8B200 | GYTFTNYW 229 | IDPSDSET 230 | ASGLTGTGYY 231 | QDISPY 232 | YTS 233 | QQDNTLPYT 234 |
| 8 CD8B247 | GYTFTDYY 263 | VIPNNGGT 264 | AREDYSNQGFFLDAMDY 265 | QTISHF 266 | YAS 267 | QSGHSFPYT 268 |
| 9 CD8B265 | GYSFTDYY 297 | VIPRNGAT 298 | AREDFSNQGFFLDAMDY 299 | QSISHY 300 | YAS 301 | QNGHSFPYT 302 |
| 10 CD8B270 | GYTFTNYW 331 | IDPSDSET 332 | ASGLTGTGYY 333 | QDIRPY 334 | FTS 335 | QQDNTLPYT 336 |
| 11 CD8B213 | GYIFTDYY 365 | IYPNNGIT 366 | ARSIYYDHGGGFPY 367 | QNVDKY 368 | SAS 369 | QQYNTYPS 370 |
| 12 CD8B240 | GYTFTDYY 399 | VIPSNGGT 400 | AREDYNNQGFFLDAMDY 401 | QSISDF 402 | YAS 403 | QNGHSFPYT 404 |
| 13 CD8B361 | GYTFTDYY 433 | IYPNNGDT 434 | ARSIYYDHGGGFPY 435 | QNVGTY 436 | SAS 437 | QQYNSYPT 438 |
| 14 CD8B246 | GFSLSTSGMNIWWDDDK 467 | | ARRGNYGNYEFAY 469 | QDIRNY 470 | HTS 471 | QQGNTLPWT 472 |

TABLE 7-continued

IMGT CDR Amino Acid Sequences of CD8 Antibodies

| # | Protein Name | HC IMGT CDR1 | HC IMGT CDR2 | HC IMGT CDR3 | LC IMGT CDR1 | LC IMGT CDR2 | LC IMGT CDR3 |
|---|---|---|---|---|---|---|---|
| 15 | CD8B268 | GYTFTVYT 501 | FYPGSGNI 502 | ARHEDNHYYDGNSWFAY 503 | GNIHNY 504 | NAK 505 | QHFWNTPYT 506 |
| 16 | CD8B271 | GFSLSIYS 535 | IWGGGDT 536 | ARNPHYYGGTYEYFDV 537 | QGISNY 538 | DTS 539 | QQYSNLPYT 540 |
| 17 | CD8B273 | GYTFTEYT 569 | FYPGTGSI 570 | ARHEDNHYYDGNSWFAY 571 | GNIHNY 572 | NAK 573 | QHFWSTPYT 574 |
| 18 | CD8B288 | GYTFTEYT 603 | FYPGNGNM 604 | ARYEDNHYYDGASWFAY 605 | GNIHNY 606 | NAK 607 | QHFWSTPFT 608 |
| 19 | CD8B292 | GFNFKDDY 637 | IDPENGAT 638 | SLHDYGYAMDY 639 | SSVSSSY 640 | STS 641 | HQYHRSPLT 642 |
| 20 | CD8B303 | GFSLSIYS 671 | IWGGGST 672 | ARNPHHYGGSTGAMDY 673 | QDIKKY 674 | YTS 675 | LQYDNLFT 676 |
| 21 | CD8B304 | GFSLSTSGMN 705 | IWWDDDK 706 | ARRGNYGNYEFAY 707 | QDIRNY 708 | HTS 709 | QQGNTLPWT 710 |
| 22 | CD8B312 | GYTFTSFW 739 | VDPSDSQT 740 | ARSTYYRYDGPFTY 741 | QSINNN 742 | YTS 743 | QQSNSWPLT 744 |
| 23 | CD8B347 | GYTFTSYW 773 | VNPSNSYT 774 | ARSGLYNTNHLAWFAY 775 | GNIHNY 776 | NAE 777 | QHFWNNPLT 778 |
| 24 | CD8B350 | GYTFAAYW 807 | INPSNGYT 808 | SRSGLYYTNHLAWCPY 809 | GNIHNY 810 | NAE 811 | QHFWNSPLT 812 |
| 25 | CD8B356 | GYSITSGYY 841 | ISYDGSN 842 | VRNHGDAMDY 843 | QNVGTA 844 | SAS 845 | QQYSSYLT 846 |
| 26 | CD8B369 | GFTFTNTY 875 | IYTGTGGT 876 | ARTNWDWYFDV 877 | ENIYSY 878 | YAK 879 | QHHYGRPYT 880 |
| 27 | CD8B371 | GFTFSDYY 909 | INYDGSIT 910 | AREDYSNYGFAY 911 | QNINVW 912 | KAS 913 | QQGQSYPLT 914 |
| 28 | CD8B182 | GYTFTSYW 943 | VNPTNYYT 944 | ARSGLYNTNHLAWFAY 945 | ENIHNY 946 | NAK 947 | QHFWTTPLT 948 |
| 29 | CD8B205 | GYSFNSYW 977 | IDPSDSET 978 | ARVYYSYYSYDATYFDY 979 | ENIYSY 980 | NAK 981 | QHHYTTPLT 982 |
| 30 | CD8B223 | GFSLTSYS 1011 | IWAGGST 1012 | AKHSYYSFDAFDY 1013 | QNVNTD 1014 | SAS 1015 | QQCNSYPLT 1016 |
| 31 | CD8B234 | GYSITSGYY 1045 | INYDGRN 1046 | SRDQGYSKFYFDY 1047 | EDIYNR 1048 | GAT 1049 | QQYWSFPRT 1050 |
| 32 | CD8B251 | GFSLTTYA 1079 | IWSGGST 1080 | ARHSYYHYNAMDN 1081 | QNVGTA 1082 | SAS 1083 | QQYSSYPFT 1084 |
| 33 | CD8B269 | GYSITSGYY 1113 | ISYDGSN 1114 | VRNHGDAMDH 1115 | QNVGTD 1116 | SAS 1117 | QQYKSYPLT 1118 |
| 34 | CD8B290 | GFSLSRYS 1147 | IWGGGST 1148 | ARIYFDNYVGFAY 1149 | QDVGTV 1150 | WTS 1151 | QQYSSYPYT 1152 |
| 35 | CD8B310 | GFSLTNYA 1181 | IWTDGST 1182 | ARNNGYFPAFFAY 1183 | QTIVHSNGNTY 1184 | KVS 1185 | FQGSHAPFT 1186 |
| 36 | CD8B352 | GYSITSGYY 1215 | INYDGRN 1216 | ARDQGYSKFYFDY 1217 | EDIYNR 1218 | GAT 1219 | QQYWSFPRT 1220 |
| 37 | CD8B319 | GYSFTAYY 1249 | INPSAGGT 1250 | ARWTNPFDY 1251 | QNVGTA 1252 | SAS 1253 | QQYNNYLT 1254 |
| 38 | CD8B194 | GYTFTSYW 1283 | IYPGSSST 1284 | ARELGPYYRYSAMVY 1285 | QNVGTA 1286 | SAS 1287 | QQYSSYPFT 1288 |
| 39 | CD8B231 | GYTFTNYW 1317 | IDPSDSET 1318 | ASGLTGTGHY 1319 | QDINIY 1320 | HTS 1321 | QQDNTLPYT 1322 |

TABLE 7-continued

IMGT CDR Amino Acid Sequences of CD8 Antibodies

| # | Protein Name | HC IMGT CDR1 | HC IMGT CDR2 | HC IMGT CDR3 | LC IMGT CDR1 | LC IMGT CDR2 | LC IMGT CDR3 |
|---|---|---|---|---|---|---|---|
| 40 | CD8B238 | GYTFTDYS 1351 | IYTYSGGA 1352 | ARDSSDYEFAY 1353 | QDIKSY 1354 | RAN 1355 | LQYDEFRT 1356 |
| 41 | CD8B255 | GFSLNTSGMGIFWDDDK 1385 | 1386 | ARRDGYGDYAYFDV 1387 | ENIYSD 1388 | AAT 1389 | QHFWGTPWT 1390 |
| 42 | CD8B324 | GYTSTSHW 1419 | IYPGSSST 1420 | ARHSPGHRDYAMDY 1421 | QNVGTA 1422 | SAS 1423 | QQYSTYPLT 1424 |
| 43 | CD8B337 | GFSLSTSGMGIFWDDDR 1453 | 1454 | ARRVGYGDYAYFDV 1455 | ENIYSD 1456 | AAT 1457 | QHFWGTPWT 1458 |
| 44 | CD8B344 | GYSFTNYW 1487 | IYPGSDSS 1488 | AREEADYRYTWFVY 1489 | QNVGTA 1490 | SAS 1491 | QQYSSYPLT 1492 |
| 45 | CD8B264 | GYSFTSYW 1521 | IYPGSSST 1522 | AREEYSYKSSWFAY 1523 | QNVGTA 1524 | SAS 1525 | QQYSTYPYT 1526 |
| 46 | CD8B318 | GYTFTSYW 1555 | IYPGSSSS 1556 | AREEYSYFPSWFAY 1557 | QNVGTA 1558 | SAS 1559 | QQYSTYPFT 1560 |
| 47 | CD8B333 | GYSFASFW 1589 | IYPGSSST 1590 | AREEYSYKSSWFAY 1591 | QNVGTA 1592 | SAS 1593 | QQYSTYPYT 1594 |
| 48 | CD8B366 | GFNIKDDY 1623 | IDPANGNP 1624 | ARDDEGYYYFDV 1625 | KSISKY 1626 | SGS 1627 | QQHNEYPLT 1628 |
| 49 | CD8B368 | GYTFTSYW 1657 | IYPFSSST 1658 | AREEFSHYPSWFAY 1659 | QNVGIA 1660 | SAS 1661 | QQYSTDPYT 1662 |
| 50 | CD8B370 | GYTFTSYW 1691 | IYPGSSST 1692 | TRELGAYYHYSAMDY 1693 | QNVGTA 1694 | SAS 1695 | QQYSIYPFT 1696 |
| 51 | CD8B186 | GYIFTSYW 1725 | INPSSGYA 1726 | ARRVFYGDSWFAY 1727 | GNIHNY 1728 | NAK 1729 | QHFWSTTWT 1730 |
| 52 | CD8B190 | GYSFTSYY 1759 | IDPFNGNT 1760 | ASPNSNYVGTWFAY 1761 | QNINVW 1762 | KAS 1763 | QQGQSFPFT 1764 |
| 53 | CD8B192 | GYTFTDYY 1793 | INPYNGGT 1794 | ARNYGAMDS 1795 | GNIHNY 1796 | NAK 1797 | QHFWITPPT 1798 |
| 54 | CD8B193 | GYKFTDYY 1827 | INPNGGGT 1828 | ARTSGTDWYFDV 1829 | QNVGTA 1830 | SAS 1831 | QQYSSYPFT 1832 |
| 55 | CD8B214 | GYTFTTAG 1861 | INTHAGES 1862 | ARSGDYDGSHPFAY 1863 | QDIRPY 1864 | YTS 1865 | QQDNTLPYT 1866 |
| 56 | CD8B230 | GYTFTDYY 1895 | INPNGGGT 1896 | ARTSGTDWYFDV 1897 | QNVGTA 1898 | STS 1899 | QQYSIYPFT 1900 |
| 57 | CD8B245 | GFTFTDYY 1929 | SRNKGNGYTT 1930 | ARTVTGTLFYYALDY 1931 | ENIYSY 1932 | NAK 1933 | QHHYGTPLT 1934 |
| 58 | CD8B248 | GYTFTTYT 1963 | INPSSGYT 1964 | ARLWAY 1965 | QSLVHSSGNTY 1966 | KGS 1967 | SQSTHVPFT 1968 |
| 59 | CD8B250 | GFSLSNYV 1997 | IWTDGST 1998 | ARNNGYFPAFFAY 1999 | QNVDTD 2000 | SAS 2001 | QQYNSYPLT 2002 |
| 60 | CD8B254 | GYTFSSYW 2031 | IYPGSGST 2032 | ARESITTRITPFDH 2033 | QSLVHSSGNTY 2034 | KGS 2035 | SQSTHVPFT 2036 |
| 61 | CD8B261 | GYTFNSYW 2065 | IYPGSSST 2066 | ARELGGYYRYNAMDY 2067 | QDINRY 2068 | RAN 2069 | LQYDEFPYT 2070 |
| 62 | CD8B311 | GYTFTSYW 2099 | IHPNSGST 2100 | ARCGYDGAWFAY 2101 | QGISNC 2102 | YTS 2103 | QQYSKVPYT 2104 |
| 63 | CD8B340 | GYTFTNYW 2133 | IDPSDTFT 2134 | ARGDWDRDWYFDV 2135 | QSLLYSDGKTY 2136 | LVS 2137 | LQATHFPHT 2138 |
| 64 | CD8B362 | GFNIKDTY 2167 | IDPANGHT 2168 | AIRFAY 2169 | HEISGY 2170 | AAS 2171 | LQYSSYPYT 2172 |

1.2: Evaluation of Binding to Human CD8+ T Cells and Biophysical Characterization of CD8 Antibodies Cell binding. Twenty nM antibody was incubated with human pan T cell in assay media (RPMI 1640+1000 HI FBS+ Pen/strep) for 1 hour at 37° C. Secondary antibodies were A647-conjugated goat anti human IgG Fc antibody at 2 µg/mL, and A488-conjugated mouse anti-human CD4 at 1 Hg/mL in staining buffer. Live cells were also gated based on OKT8 control mAb binding. Percent CD8 positive population was calculated by percentage of CD8-positive cell count/live cell count. Results are shown in Table 8 and are reported as Geomean ratios from CD4-negative population (00 CD8-positive population).

Cross-interaction chromatography (CIC): CIC was conducted as previously described (Jacobs et al. (2010) Pharm. Res. 27(1):65-71). Results are shown in Table 8.

Thermal unfolding and aggregation (Tm/Tagg): Thermal unfolding and aggregation was measured 20° C.-95° C. in 1 C/min ramp using Nanodsf Nanotemper's, Prometheus NT.48 instrument. Samples of 20 µL (0.2 mg/mL) in PBS buffer were transferred to 384-well plate in duplicate.

Data was analyzed using PR.THERMCONTROL software. Results are shown in Table 8.

TABLE 8

CD8 Antibody Stability and Binding to Human Pan T Cells

| # | Protein Name | Cell Binding to Human PanT Signal/Background (of CD4 negative population) | CIC Peak Retention Time | Protein Stability Tm1 (° C.) | Tagg (° C.) |
|---|---|---|---|---|---|
| 1 | CD8B191 | 2440 | 4.32 | 70.3 | 76.6 |
| 2 | CD8B226 | 1752 | 4.34 | 70.2 | 78.0 |
| 3 | CD8B259 | 1934 | 4.41 | 70.5 | 76.8 |
| 4 | CD8B298 | 306 | 4.29 | 70.6 | 76.2 |
| 5 | CD8B342 | 1324 | 4.27 | 67.5 | 68.7 |
| 6 | CD8B364 | 1562 | 4.24 | 65.3 | 70.7 |
| 7 | CD8B200 | 1990 | 4.23 | 69.3 | 82.3 |
| 8 | CD8B247 | 1646 | 4.31 | 70.1 | 77.4 |
| 9 | CD8B265 | 2076 | 4.39 | 70.3 | 79.0 |
| 10 | CD8B270 | 2497 | 4.32 | 70.1 | 79.7 |
| 11 | CD8B213 | 827 | 4.51 | 67.8 | 69.9 |
| 12 | CD8B240 | 1312 | 4.30 | 70.0 | 81.5 |
| 13 | CD8B361 | 1051 | 4.65 | 71.1 | 74.4 |
| 14 | CD8B246 | 1112 | 4.47 | 60.9 | 63.1 |
| 15 | CD8B268 | 1173 | 4.44 | 69.6 | 72.4 |
| 16 | CD8B271 | 911 | 4.34 | 69.1 | 80.4 |
| 17 | CD8B273 | 938 | 4.27 | 73.0 | 76.9 |
| 18 | CD8B288 | 934 | 4.32 | 71.0 | 73.5 |
| 19 | CD8B292 | 910 | 4.23 | 68.1 | 69.2 |
| 20 | CD8B303 | 1182 | 4.37 | 70.2 | 79.9 |
| 21 | CD8B304 | 923 | 4.43 | 64.4 | 66.4 |
| 22 | CD8B312 | 1087 | 4.29 | 71.3 | 78.0 |
| 23 | CD8B347 | 1201 | 4.30 | 71.1 | 73.1 |
| 24 | CD8B350 | 537 | 4.61 |  | 81.3 |
| 25 | CD8B356 | 777 | 4.46 | 73.9 | 76.7 |
| 26 | CD8B369 | 685 | 5.83 | 67.4 | 76.2 |
| 27 | CD8B371 | 64 | 4.29 | 69.1 | 75.0 |
| 28 | CD8B182 | 1490 | 4.58 | 70.7 | 77.8 |
| 29 | CD8B205 | 655 | 4.77 | 68.9 | 72.2 |
| 30 | CD8B223 | 489 | 4.46 | 68.3 | 74.3 |
| 31 | CD8B234 | 856 | 5.16 | 67.7 | 69.0 |
| 32 | CD8B251 | 37 | 5.30 | 69.4 | 73.0 |
| 33 | CD8B269 | 26 | 4.28 | 69.8 | 81.4 |
| 34 | CD8B290 | 1155 | 4.48 | 60.5 | 72.0 |
| 35 | CD8B310 | 29 | 4.32 | 70.7 | 78.7 |
| 36 | CD8B352 | 827 | 5.56 | 72.1 | 72.6 |
| 37 | CD8B319 | 16 | 4.54 | 64.8 | 75.6 |
| 38 | CD8B194 | 1972 | 4.81 | 69.8 | 87.2 |
| 39 | CD8B231 | 1785 | 4.19 | 61.7 | 77.5 |
| 40 | CD8B238 | 1 | 4.38 | 69.9 | 78.3 |
| 41 | CD8B255 | 1317 | 4.25 | 69.5 | 78.4 |
| 42 | CD8B324 | 1611 | 4.44 | 66.9 | 68.9 |
| 43 | CD8B337 | 1983 | 4.42 | 68.8 | 73.2 |
| 44 | CD8B344 | 1758 | 4.26 | 72.4 | 75.4 |
| 45 | CD8B264 | 122 | 4.34 | 70.0 | 87.2 |
| 46 | CD8B318 | 1613 | 4.78 |  | 78.0 |
| 47 | CD8B333 | 1843 | 4.24 | 70.4 | 85.0 |
| 48 | CD8B366 | 318 | 4.26 | 71.8 | 74.9 |
| 49 | CD8B368 | 2007 | 4.46 | 70.5 | 74.7 |
| 50 | CD8B370 | 1932 | 4.69 | 70.1 | 86.9 |
| 51 | CD8B186 | 36 | 4.94 | 65.1 | 66.4 |
| 52 | CD8B190 | 44 | 4.34 | 67.9 | 77.0 |
| 53 | CD8B192 | 22 | 4.84 | 70.2 | 79.9 |
| 54 | CD8B193 | 641 | 5.48 | 70.3 | 79.6 |
| 55 | CD8B214 | 232 | 4.16 | 68.1 | 73.9 |
| 56 | CD8B230 | 63 | 4.88 | 69.6 | 82.5 |
| 57 | CD8B245 | 44 | 4.36 | 66.7 | 68.3 |
| 58 | CD8B248 | 20 | 4.57 | 68.4 | 73.8 |
| 59 | CD8B250 | 61 | 4.42 | 69.9 | 79.3 |
| 60 | CD8B254 | 23 | 4.22 | 65.8 | 69.8 |
| 61 | CD8B261 | 34 | 4.52 | 70.5 | 79.0 |
| 62 | CD8B311 | 1 | 4.28 | 69.8 | 78.0 |
| 63 | CD8B340 | 8 | 4.21 | 64.8 | 78.0 |
| 64 | CD8B362 | 4 | 4.37 | 69.6 | 76.0 |

Protein binding kinetics by surface plasmon resonance (SPR). All 64 mAbs were captured at 1 µg/ml, with a final capture level ranging from 100 to 400 Rus. Binding to human CD8αβ heterodimer (R&D cat #9358-CD) and hCD8αα homodimer (Table 9) at 11.1 nM, 33.3 nM and 100 nM was measured using a single cycle kinetics method with an association and dissociation of 3 and 10 minutes, respectively, using a flow rate of 50 uL/mL. Biacore 8k was utilized for these assays, and data was analyzed by modeling to a 1:1 binding equation. Results are shown in Table 10.

TABLE 9

CD8αα screening reagents

| Name | Protein ID | Sequence | SEQ ID NO |
|---|---|---|---|
| Human CD8αα fused to human Fc | hCDaa | MAWVWILLFLMAAAQSIQASQFRVSPLDR TWNLGETVELKCQVLLSNPTSGCSWLFQP RGAAASPTFLLYLSQNKPKAAEGLDTQRF SGKRLGDTFVLTLSDFRRENEGYYFCSAL SNSIMYFSHFVPVFLPAKPTTTPAPRPPT PAPTIASQPLSLRPEACRPAAGGAVHIRG LDFACDEPKSCDKTHTCPPCPAPELLGGP SVFLFPPKPKDTLMISRTPEVICVVVDVS HEDPEVKFNWYVDGVEVHNAKTKPREEQY NSTYRVVSVLTVLHQDWLNGKEYKCKVSN KALPAPIEKTISKAKGQPREPQVYILPPS RDELTKNQVSLTCLVKGFYPSDIAVEWES NGQPENNYKTTPPVLDSDGSFFLYSKLTV DKSRWQQGNVFSCSVMHEALHNHYTQKSL SLSPGK | 4967 |

TABLE 10

CD8 Antibody Binding by SPR

| # | Protein Name | Protein binding by SPR to human CD8αα homodimer | | | | Protein binding by SPR to human CD8 αβ heterodimer | | | | Based on SPR Data Predicted Epitope |
|---|---|---|---|---|---|---|---|---|---|---|
| | | ka (1/Ms) | kd (1/s) | KD (M) | Comment | hCD8αβ ka (1/Ms) | hCD8α kd (1/s) | hCD8αβ KD (M) | hCD8αβ Comment | |
| 1 | CD8B191 | 1.23E+05 | 1.19E−04 | 9.68E−10 | | 1.23E+05 | 1.19E−04 | 9.68E−10 | | CD8 α |
| 2 | CD8B226 | 1.55E+05 | 3.42E−04 | 2.21E−09 | | 1.55E+05 | 3.42E−04 | 2.21E−09 | | CD8 α |
| 3 | CD8B259 | 2.09E+05 | 2.52E−04 | 1.20E−09 | | 2.09E+05 | 2.52E−04 | 1.20E−09 | | CD8 α |
| 4 | CD8B298 | 1.32E+05 | 2.11E−04 | 1.60E−09 | | 1.32E+05 | 2.11E−04 | 1.60E−09 | | CD8 α |
| 5 | CD8B342 | 1.48E+05 | 3.84E−04 | 2.59E−09 | | 1.48E+05 | 3.84E−04 | 2.59E−09 | | CD8 α |
| 6 | CD8B364 | 1.43E+06 | 3.12E−02 | 2.19E−08 | | 1.43E+06 | 3.12E−02 | 2.19E−08 | | CD8 α |
| 7 | CD8B200 | 3.32E+06 | 1.26E−04 | 3.80E−11 | | 3.32E+06 | 1.26E−04 | 3.80E−11 | | CD8 α |
| 8 | CD8B247 | 2.73E+05 | 2.81E−04 | 1.03E−09 | | 2.73E+05 | 2.81E−04 | 1.03E−09 | | CD8 α |
| 9 | CD8B265 | 1.68E+05 | 1.33E−04 | 7.91E−10 | | 1.68E+05 | 1.33E−04 | 7.91E−10 | | CD8 α |
| 10 | CD8B270 | 2.41E+06 | 9.47E−05 | 3.93E−11 | | 2.41E+06 | 9.47E−05 | 3.93E−11 | | CD8 α |
| 11 | CD8B213 | — | — | — | Poor Fit, ~5 nM | — | — | — | Poor Fit, ~5 nM | CD8 α |
| 12 | CD8B240 | — | — | — | Poor Fit, ~1 nM | — | — | — | Poor Fit, ~1 nM | CD8 α |
| 13 | CD8B361 | — | — | — | Poor Fit, ~1 nM | — | — | — | Poor Fit, ~1 nM | CD8 α |
| 14 | CD8B246 | — | — | — | Low/No Binding | — | — | — | Low/No Binding | CD8 β |
| 15 | CD8B268 | — | — | — | Low/No Binding | — | — | — | Low/No Binding | CD8 β |
| 16 | CD8B271 | — | — | — | Low/No Binding | — | — | — | Low/No Binding | CD8 β |
| 17 | CD8B273 | — | — | — | Low/No Binding | — | — | — | Low/No Binding | CD8 β |
| 18 | CD8B288 | — | — | — | Low/No Binding | — | — | — | Low/No Binding | CD8 β |
| 19 | CD8B292 | — | — | — | Low/No Binding | — | — | — | Low/No Binding | CD8 β |
| 20 | CD8B303 | — | — | — | Low/No Binding | — | — | — | Low/No Binding | CD8 β |
| 21 | CD8B304 | — | — | — | Low/No Binding | — | — | — | Low/No Binding | CD8 β |
| 22 | CD8B312 | — | — | — | Low/No Binding | — | — | — | Low/No Binding | CD8 β |
| 23 | CD8B347 | — | — | — | Low/No Binding | — | — | — | Low/No Binding | CD8 β |
| 24 | CD8B350 | — | — | — | Low/No Binding | — | — | — | Low/No Binding | CD8 β |
| 25 | CD8B356 | — | — | — | Low/No Binding | — | — | — | Low/No Binding | CD8 β |
| 26 | CD8B369 | — | — | — | Low/No Binding | — | — | — | Low/No Binding | CD8 β |
| 27 | CD8B371 | — | — | — | Low/No Binding | — | — | — | Low/No Binding | CD8 β |
| 28 | CD8B182 | — | — | — | Low/No Binding | — | — | — | Low/No Binding | CD8 β |
| 29 | CD8B205 | — | — | — | Low/No Binding | — | — | — | Low/No Binding | CD8 β |
| 30 | CD8B223 | — | — | — | Low/No Binding | — | — | — | Low/No Binding | CD8 β |
| 31 | CD8B234 | — | — | — | Low/No Binding | — | — | — | Low/No Binding | CD8 β |
| 32 | CD8B251 | — | — | — | Low/No Binding | — | — | — | Low/No Binding | CD8 β |
| 33 | CD8B269 | — | — | — | Low/No Binding | — | — | — | Low/No Binding | CD8 β |
| 34 | CD8B290 | — | — | — | Low/No Binding | — | — | — | Low/No Binding | CD8 β |
| 35 | CD8B310 | — | — | — | Low/No Binding | — | — | — | Low/No Binding | CD8 β |
| 36 | CD8B352 | — | — | — | Low/No Binding | — | — | — | Low/No Binding | CD8 β |
| 37 | CD8B319 | — | — | — | Low/No Binding | — | — | — | Low/No Binding | CD8 β |
| 38 | CD8B194 | — | — | — | Poor Fit, ~1 nM | — | — | — | Poor Fit, ~1 nM | CD8 α/β interface |
| 39 | CD8B231 | — | — | — | Poor Fit, ~0.5 nM | — | — | — | Poor Fit, ~0.5 nM | CD8 α/β interface |
| 40 | CD8B238 | — | — | — | Poor Fit, ~200 pM | — | — | — | Poor Fit, ~200 pM | CD8 α/β interface |

TABLE 10-continued

CD8 Antibody Binding by SPR

| # | Protein Name | Protein binding by SPR to human CD8αα homodimer | | | | Protein binding by SPR to human CD8 αβ heterodimer | | | | Based on SPR Data Predicted Epitope |
|---|---|---|---|---|---|---|---|---|---|---|
| | | ka (1/Ms) | kd (1/s) | KD (M) | Comment | hCD8αβ ka (1/Ms) | hCD8α kd (1/s) | hCD8αβ KD (M) | hCD8αβ Comment | |
| 41 | CD8B255 | — | — | — | Poor Fit, ~1 nM | — | — | — | Poor Fit, ~1 nM | CD8 α/β interface |
| 42 | CD8B324 | — | — | — | Poor Fit, ~1 nM | — | — | — | Poor Fit, ~1 nM | CD8 α/β interface |
| 43 | CD8B337 | — | — | — | Poor Fit, ~1 nM | — | — | — | Poor Fit, ~1 nM | CD8 α/β interface |
| 44 | CD8B344 | — | — | — | Poor Fit, ~5 nm | — | — | — | Poor Fit, ~5 nm | CD8 α/β interface |
| 45 | CD8B264 | — | — | — | Poor Fit, ~0.5 nM | — | — | — | Poor Fit, ~0.5 nM | CD8 α/β interface |
| 46 | CD8B318 | — | — | — | Poor Fit, ~1 nM | — | — | — | Poor Fit, ~1 nM | CD8 α/β interface |
| 47 | CD8B333 | — | — | — | Poor Fit, ~1 nM | — | — | — | Poor Fit, ~1 nM | CD8 α/β interface |
| 48 | CD8B366 | — | — | — | Poor Fit, ~20 nM | — | — | — | Poor Fit, ~20 nM | CD8 α/β interface |
| 49 | CD8B368 | — | — | — | Poor Fit, ~0.5 nM | — | — | — | Poor Fit, ~0.5 nM | CD8 α/β interface |
| 50 | CD8B370 | — | — | — | Poor Fit, ~5 nm | — | — | — | Poor Fit, ~5 nm | CD8 α/β interface |
| 51 | CD8B186 | — | — | — | Low/No Binding | — | — | — | Low/No Binding | — |
| 52 | CD8B190 | — | — | — | Low/No Binding | — | — | — | Low/No Binding | — |
| 53 | CD8B192 | — | — | — | Low/No Binding | — | — | — | Low/No Binding | — |
| 54 | CD8B193 | — | — | — | Low/No Binding | — | — | — | Low/No Binding | — |
| 55 | CD8B214 | — | — | — | Low/No Binding | — | — | — | Low/No Binding | — |
| 56 | CD8B230 | — | — | — | Low/No Binding | — | — | — | Low/No Binding | — |
| 57 | CD8B245 | — | — | — | Low/No Binding | — | — | — | Low/No Binding | — |
| 58 | CD8B248 | — | — | — | Low/No Binding | — | — | — | Low/No Binding | — |
| 59 | CD8B250 | — | — | — | Low/No Binding | — | — | — | Low/No Binding | — |
| 60 | CD8B254 | — | — | — | Low/No Binding | — | — | — | Low/No Binding | — |
| 61 | CD8B261 | — | — | — | Low/No Binding | — | — | — | Low/No Binding | — |
| 62 | CD8B311 | — | — | — | Low/No Binding | — | — | — | Low/No Binding | — |
| 63 | CD8B340 | — | — | — | Low/No Binding | — | — | — | Low/No Binding | — |
| 64 | CD8B362 | — | — | — | Low/No Binding | — | — | — | Low/No Binding | — |

Example 2: Production and Characterization of Antibodies that Bind CD4

2.1: Immunization

One group of (N=8) AlivaMab Mouse Kappa mice were immunized on an AMMPD-4 immunization schedule using human CD4 (R&D Systems Cat #10327-CD) and rhesus CD4-HIS (Acro Biosystems, Cat #CD4-C52H7.) IgG specific ELISA titers were assessed on D20, D27 and D34 on both human CD4 and rhesus CD4 recombinant proteins. Additionally, FACS titers were assessed on D27 and D34 on human SKW3 and SKW3:hCD4 Knockout cells to assess cell expressed CD4 IgG titers in the mice. All mice were selected for the hybridoma fusion and were given a final protein immunization containing human and rhesus CD4 protein 3 days before harvesting of splenic and lymph node material for fusion.

2.2: Hybridoma Method

On the day of immunization, mice were euthanized by cervical dislocation and spleens and lymph nodes were aseptically harvested and processed separately into single cell suspensions. Spleen material was resuspended in red blood cell lysis buffer (Sigma Cat #R7757) to lyse red blood cells. Both spleen and lymph node material were enriched for B cells using ADS standard magnetic selection method prior to fusion which is a negative selection protocol that removes unwanted cells in the lymphocyte preparations prior to fusion.

Spleen and lymph node material were mixed with SP2/0 myeloma cells and washed 3 times in electrofusion buffer prior to fusion. Hybridoma fusion was performed by Electrofusion on the NEPAgene ECFG21 cell fusion system using ADS standard fusion conditions. Fused cells are rested for 5 minutes at room temperature before being removed from the fusion chamber and added to fusion media for plating into 384W plates or bulk culture to cryopreserve fusion material. 14×384W plates were seeded with fusion material in HAT containing media for the first hybridoma campaign from 10% of the total fusion material. The remaining 90% of the fused cells were bulk plated in HAT containing media and cryopreserved the following day. Cells were grown for 9 days in 384W plates and then screened by FACS to identify αCD4 IgG producing hybridoma wells.

2.3: Antibody Recovery and Screening Protocols:

FACS cell binding. αCD4 antibody producing hybridomas were identified by cell surface CD4 binding using FACS. For primary screening SKW3 (human T-ALL) was used as the CD4 positive cell line and SKW3 CD4 knockout (KO) as the negative cell line, respectively. SKW3 KO cells were labeled with Tag-it Violet (BioLegend) at RT for 15 min. After removing extra dye by washing cells with FACS buffer (1% BSA/1 mM EDTA/0.05% NaN3 in PBS) equal number of SKW3 and labeled SKW3 CD4 KO cells were combined, washed, and resuspended in FACS buffer at 8E6 cells/6 mL. Hybridoma supernatants (15 µL/well) were transferred to 384 well v-bottom plates. anti-hCD4 mIgG (clone RPA-T4 at 2 µg/mL) as positive staining control and PBS was used as negative staining control. Cells (~20K/15 µL/well) were added to the supernatant and incubated at 4° C. for 30 minutes. After washing cells with FACS buffer twice mixture of anti-mouse Fcγ (Jackson ImmunoResearch, cat #115-605-071) and anti-human Kappa (Southern Biotech, cat #2061-02) to the cells (15 µL/well) and incubated at 4° C. for 30 minutes. Cells were washed twice before acquired by IQUE3® Flow Cytometer and analyzed with FORECYT® software (Sartorius). Positive wells were selected with the following criteria: Over 2-fold selective binding to SKW3 cell line relative to SKW3 CD4 KO with over 10% signal above background binding with anti-human Kappa. Hybridomas from primary screening positive wells were transferred to 96 well plates.

FACS Confirmation screens were performed for primary screening positive hybridomas using human PBMCs in addition to SKW3/SKW3 CD4 KO cell lines. PBMCs were thawed and resuspended to 8E6/mL in FACS buffer. Hybridoma supernatants (25 µL/well) were transferred to 96 v-bottom plates. anti-hCD4 mIgG (clone RPA-T4 at 2 µg/mL) and anti-hCD4 mIgG (clone OKT4 at 2 µg/mL) as positive staining controls and FACS buffer was used as negative staining control. PBMCs were added to the 96 well plates (25 µL/well) and incubated at 4° C. for 30 minutes. After washing cells with FACS buffer twice mixture of anti-mouse Fcγ (Jackson ImmunoResearch, cat #115-605-071) and Helix Blue™ (BioLegend) (nucleic acid probe) to the cells (25 µL/well), and incubated at 4° C. for 30 minutes. Cells were washed twice before acquired by IQUE30 Flow Cytometer and analyzed with FORECYT® software (Sartorius). Primary parameter used to assess confirmation was CD4 positive percent of viable cells. CD4 positive cell population was determined by positive staining controls (OKT4 and RPA-T4) described above. SKW3 gMFI binding was used as secondary parameter to assess confirmation. Results are shown in Table 18.

Supernatant screening by Octet (Human CD4). The kinetics of ADS75110 non-clonal supernatants for human CD4 protein was measured using biolayer interferometry on an Octet® Red 384 instrument. Kinetic rate constants and equilibrium dissociation constant were determined using the following reagents: (1) ADS Octet® Red384 (interferometry instrument) Kinetics Assessment Sensors: Anti Mouse IgG Fc Capture (AMC) (Lot 2001073); (2) ADS Octet® Red384 (interferometry instrument) Kinetics Assessment Buffers and Solutions: Kinetics Buffer (PBS, 0.1% BSA, 0.02% Tween-20® (detergent), 0.05% Azide) (Lot 20200331); Regeneration Solution (10 mM Glycine pH 1.7) (Lot 20190612); (3) ADS Octet® Red384 (interferometry instrument) Kinetics Assessment Antibodies and Analytes Used: Recombinant human CD4 (R&D Systems, Cat. 10327-CD, Lot DCSC042004A) with Analyte Concentration Assayed for Binding at 100 nM; and ADS75110 Non-Clonal Supernatant (AlivaMab) Antibody Concentration Used for Loading of 1:3 dilution in kinetics buffer.

Kinetic assessments. Binding kinetics for nonclonal hybridoma supernatants were screened in high throughput against a single concentration of recombinant human CD4 protein (100 nM). Supernatants were diluted 1:3 in kinetics buffer. One hundred microliters of diluted supernatants were added to 384W screening plates. AMC sensors were used to capture hybridoma antibodies from supernatants. Kinetic parameters for ADS75110 nonclonal hybridomas supernatants were determined at 27° C. using the following conditions: Initial AMC Sensor Regeneration of 2×30 s; Initial Baseline of 300 s; Baseline of 120 s; ADS 75110 AMM Ab Loading of 300 s; Baseline of 120 s; Human/rhesus CD4 association of 300 s; Human/rhesus CD4 dissociation 600 s; AMC Sensor Regeneration of 120 s; Total of 33 minutes.

After completion of the kinetic characterization assays, data was analyzed in FORTE BIO analysis software v11. The Y-axis was aligned to the final 5 seconds of the baseline step, with inter-step alignment to the dissociation step. Savitzky-Golay Filtering was used to smooth the data. Kinetic curves were fit to both association and dissociation steps using a 1:1 stoichiometry model. A local fitting was used to calculate single point kinetics for each supernatant for human CD4. Results are shown in Table 19.

Epitope binning by FACS. αCD4 containing hybridoma supernatants were binned against three comparator antibodies by FACS using SKW3 cells, which endogenously express human CD4 protein. Briefly, SKW3 cells were incubated with saturated hybridoma supernatant for 30 minutes at 4° C. The following antibodies were added to the SKW3:hybridoma supernatant mixture and incubated for 30 minutes longer at 4° C.: Mouse αhu CD4 (OKT4)—Alexa Fluor™ 488 (fluorescent dye) Conjugated; Mouse αhu CD4 (RPA-T4)-PE-Dazzle 594 Conjugated; and Human αhu CD4 (OKT4a) (αhu IgG FC Alexa Fluor™ 647 (fluorescent dye) ab used).

Cells were washed with FACS buffer and incubated with secondary antibody Gt α Hu IgG FC Alexa Fluor™ 647 (fluorescent dye) (Jackson Immunologicals, Cat #109-605-170) and Helix NP Blue™ (nucleic acid probe) live dead stain (Biolegend, Cat #425305) for 30 minutes at 4° C. After incubation, cells were washed twice with FACS buffer and data was acquired on Sartorius IQUE3® VBR FACS machine and data was analyzed in FORECYT® software.

The Sartorius IQUE3® FACS machine is a three-laser machine (Violet, Blue, Red) and standard FACS compensation was done for data analysis. Bins were set by competition of the fluorophore conjugated antibodies by a supernatant compared to the binding of fluorophore conjugated antibodies without any competitive supernatant. The three antibodies (clone OKT4, RPA-T4 and OKT4a) have known epitopes and do not compete. Four bins were identified by the single FACS experiment: competitive to OKT4, competitive with RPA-T4, competitive with OKT4a, and non-competitive with the three antibodies. Results are shown in Table 18.

2.4: Antibody Purification from Hybridoma Supernatant

Batch purifications on hybridoma supernatants were conducted to isolate antibodies. Briefly, the hybridoma supernatant salt concentration and pH were increased prior to addition of protein A resin, and this mixture was agitated end-over-end at 4° C. overnight. The supernatant was removed after centrifugation and the resin with bound antibody was transferred into a filter plate and washed four times with HEPES buffered saline (HBS). Antibodies were then eluted with 0.1 M acetic acid pH 3.5 and neutralized with 1 M Tris-Buffer (trisaminomethane) pH 8.0. This mixture was buffer exchanged into HBS using Amicon spin concentrators, 50 kD MWCO. The antibody concentration was determined using a NANODROP™ spectrophotoemeter, and purity was determined by SEC-HPLC and SDS-Page. Results are shown in Table 22.

2.5: Octet Kinetics for Purified AMM Antibodies (Human/Rhesus)

The ability of ADS75110 purified AMM Abs to bind human and rhesus CD4 proteins was measured using biolayer interferometry on an Octet® Red 384 instrument. Kinetic rate constants and equilibrium dissociation constant were using the following reagents: (1) ADS Octet® Red384 (interferometry instrument) Kinetics Assessment Sensors: Anti Mouse IgG Fc Capture (AMC) (Lot 2001073); (2) ADS Octet® Red384 (interferometry instrument) Kinetics Assessment Buffers and Solutions: Kinetics Buffer (PBS, 0.1% BSA, 0.02% Tween-20® (detergent), 0.05% Azide) (Lot 20200331); Regeneration Solution (10 mM Glycine pH 1.7) (Lot 20190612); (3) ADS Octet® Red384 (interferometry instrument) Kinetics Assessment Antibodies and Analytes Used: Recombinant human CD4 (R&D Systems, Cat. 10327-CD, Lot DCSC042004A) with Analyte Concentration Assayed for Binding at 100 nM, 50 nM and 25 nM; Rhesus macaque CD4-HIS (Acro, Cat. CD4-052H7) at 100 nM, 50 nM and 25 nM; and ADS75110 Purified AMM Abs (AlivaMab, Lot 200716) at antibody concentration of 10 μg/ml used for loading. Results are shown in Table 20 (Human CD4 (R&D Systems)) and Table 21 (Rhesus CD4 (Acro Biosystems)).

Kinetic assessments. A three-point, 1:1 serial dilution of human and rhesus CD4 proteins were prepared using kinetics buffer as diluent. ADS75110 purified AMM Abs were diluted to 10 μg/mL in kinetics buffer. 10 mM Glycine pH 1.7, and kinetics buffer were used to regenerate the AMC biosensors. 100 μL of samples and reagents were added to 384W plates (Greneir Bio, C #781209). Kinetic parameters for ADS75110 antibodies were determined using the conditions: Initial AMC Sensor Regeneration of 2×30 s; Initial Baseline of 300 s; Baseline of 120 s; ADS 75110 AMM Ab Loading of 300 s; Baseline of 120 s; Human/rhesus CD4 association of 300 s; Human/rhesus CD4 dissociation 600 s; AMC Sensor Regeneration of 120 s; Total of 33 minutes. An irrelevant antibody derived from the Alivamab mouse was included in the assay as an internal reference control.

After completion of the kinetic characterization assays, data was analyzed in Forte Bio analysis software v11. The Y-axis was aligned to the final 5 seconds of the baseline step, with inter-step alignment to the dissociation step. Savitzky-Golay Filtering was used to smooth the data. Kinetic curves were fit to both association and dissociation steps using a 1:1 stoichiometry model. A global fitting was calculated using the three-point analyte titration to derive a single set of kinetic constants for each antibody against human and rhesus CD4. Results are shown in Table 20 (Human CD4 (R&D Systems)) and Table 21 (Rhesus CD4 (Acro Biosystems)). Clonal supernatant PBMC FACS binding data is also provided in Table 22.

2.6: Sequencing

RNA was extracted from hybridomas using a Qiagen RNeasy kit (Qiagen #74104) according to manufacturer's instructions. Using primer sets specific for heavy chain sequence, kappa light chain sequence, or lambda light chain sequences, a one-step RT-PCR was performed using SuperScript™ III One-Step RT-PCR System with Platinum™ Taq DNA Polymerase (Thermo #12574026) to amplify the entire variable regions. Reactions were done in triplicate for each HC or LC. Products were run on a 2% agarose gel and products were gel extracted and sequenced by Sanger sequencing. Variable sequences for each HC or LC were confirmed if 2 or more nucleotide sequences matched 100%. If sequence was not confirmed, PCR products were placed into TOPO™ vectors (topoisomerase-based cloning) (Thermo #450030) and 10 colonies were sequenced. Open reading frames were identified and sequences were confirmed when nucleotide sequences matched exactly. Antibody variable region sequence analysis is run in house with custom Alivalign sequencing software to identify gene usage. A L234A/L235A/D265S IgG1 vector was made and sequence confirmed (data not shown).

The VH and VL sequences of certain CD4 antibodies are provided in Table 11. The CDRs sequences of certain CD4 antibodies are provided in Table 12 (Kabat), Table 13 (Chothia), Table 14 (AbM), Table 15 (Contact), and Table 16 (IMGT). Additional sequence summaries are provided in Table 17.

2.7: Reformatting of Alivamab Mouse Mabs to Fully Human Mabs

AlivaMab mouse mAbs are readily converted, recombinantly expressed, and purified as any isotype all-human antibody. For example, the nucleotide sequences of the heavy and light chain variable regions of mAbs are transferred and synthesized into DNA and inserted into vectors for recombinant expression in CHO cells. VH was cloned in a frame into a coding sequence for a human IgG1 constant region, and Vκ or VL was cloned in a frame into a coding sequence for a human Cκ or CL region, respectively. Paired HC and LC vectors were transfected into CHO expression of the recombinant fully human antibodies. The fully human IgG1 kappa or lambda mAb forms were purified from tissue culture supernatants using protein A. The fully human versions retain all the characteristics of the parental chimeric AlivaMabs.

TABLE 11

VH and VL Amino Acid Sequences of CD4 Antibodies

| # | Protein Name | HC Isotype | LC Isotype | VHAA sequence | VLAA sequence | Heavy Chain AA sequence | Light Chain AA sequence |
|---|---|---|---|---|---|---|---|
| 1 | 75110_01A06A | IgG1 | Kappa | EVQLVESGGGLVQPGG SLRLSCAASGFTFSSY WMSWVRQAPGKGLEWV ANINEDGNEKYYVDSV | DIQMTQSPSSV SASVGDRVSIT CRASQGISSWL AWYQQKPGKAP | N/A | N/A |

TABLE 11-continued

VH and VL Amino Acid Sequences of CD4 Antibodies

| # | Protein Name | HC Isotype | LC Isotype | VHAA sequence | VLAA sequence | Heavy Chain AA sequence | Light Chain AA sequence |
|---|---|---|---|---|---|---|---|
| | | | | KGRLTISRDNAKNSLY LQMNSLRAEDTAVYFC AREGGQWLSLDYWGQG ALVTVSS | KILIYGASSLQ SGVPSRFSGSG SGTDFTLTISS LQPEDFATYYC QQANSFPWTFG QGTKVEIK | | |
| | | | | 2207 | 2208 | 2209 | 2210 |
| 2 | 75110_01A07A_1 | IgG1 | Kappa | QVQLQESGPGLVKPSE TLSLTCTVSGGSIINY YWSWIRQPAGKGLEWI GRIYSSGSTNYKSSLK SRVTMSVDTSKNQFYL KLRSVTAADTAVYYCA REREAYLYYGLDVWGQ GTTVTVSS | DIQMTQSPSSL SASVGDRVTIT CQASQDIGNYL NWYQQKPGKAP KLLIYDASNLE TGVPSRFSGSG SGTDFTFTISS LQPEDLATYYC QQYDSLPLTFG GGTKVEIK | N/A | N/A |
| | | | | 2241 | 2242 | 2243 | 2244 |
| 3 | 75110_01C18A | IgG1 | Kappa | EVQLVESGGGLIQPGG SLRLSCAASGFTVSSN YMNWVRQAPGKGLEWV SVIYAGDNTYSADSVK GRFTISRDNSNNTLCL QMNSLRAEDTAVYYCA REGGTTGAFDIWGQGT MVTVSS | DIQMTQSPSSV SASVGDRVTIT CRASQGINSWL AWYQQKPGKAP KLLIYAASSLQ SGVPSRFSGSG SGTDFTLTISS LQPEDFATYYC QQGNSFPYTFG QGTKLEIK | N/A | N/A |
| | | | | 2275 | 2276 | 2277 | 2278 |
| 4 | 75110_01D24A | IgG1 | Kappa | QVQLQQWGAGLLKPSE TLSLTCAVYGGSFSGY YWSWIRQPPGKGLEWI GEINHSGSTNYNPSLK SRVTISVDTSENQFSL KLNSVTAADTAVYYCA RLVNWFDPWGQGTLVT VSS | EIQMTQSPSSV SASVGDRVTIT CRASQDISNWL AWYQQKPGKAP NLLIFAASSLQ TGVPSRFSGSG SGTDFTLTISS LQPDDFATYYC QQANSFPYSFG QGTNLGIK | QVQLQQWGAGLLKP SETLSLTCAVYGGS FSGYYWSWIRQPPG KGLEWIGEINHSGS TNYNPSLKSRVTIS VDTSENQFSLKLNS VTAADTAVYYCARL VNWFDPWGQGTLVT VSSASTKGPSVFPL APSSKSTSGGTAAL GCLVKDYFPEPVTV SWNSGALTSGVHTF PAVLQSSGLYSLSS VVTVPSSSLGTQTY ICNVNHKPSNTKVD KKVEPKSCDKTHTC PPCPAPEAAGGPSV FLFPPKPKDTLMIS RTPEVTCVVVSVSH EDPEVKFNWYVDGV EVHNAKTKPREEQY NSTYRVVSVLTVLH QDWLNGKEYKCKVS NKALPAPIEKTISK AKGQPREPQVYTLP PSRDELTKNQVSLT CLVKGFYPSDIAVE WESNGQPENNYKTT PPVLDSDGSFFLYS KLTVDKSRWQQGNV FSCSVMHEALHNHY TQKSLSLSPGK | EIQMTQSPSSVSA SVGDRVTITCRAS QDISNWLAWYQQK PGKAPNLLIFAAS SLQTGVPSRFSGS GSGTDFTLTISSL QPDDFATYYCQQA NSFPYSFGQGTNL GIKRTVAAPSVFI FPPSDEQLKSGTA SVVCLLNNFYPRE AKVQWKVDNALQS GNSQESVTEQDSK DSTYSLSSTLTLS KADYEKHKVYACE VTHQGLSSPVTKS FNRGEC |
| | | | | 2309 | 2310 | 2311 | 2312 |
| 5 | 75110_01E08A | IgG1 | Kappa | EVQLVESGGGLVQPGG SLRLSCAASGFTFNNY DMHWVRQATGKGLEWV STIGTAGDTYYPASVK GRFTIYRENAKNSLYL QMNSLRAGDTAVYYCA RGGDYYYGMDVWGQGT TVTVSS | EIVLTQSPGTL CLSPGERATLS CRASQSVSSSY LAWYQQKPGQA PRLLIYGASSR ATGIPDRFSGS GSGTDFTLTIS RLEPEDFAVYY | N/A | N/A |

TABLE 11-continued

VH and VL Amino Acid Sequences of CD4 Antibodies

| # | Protein Name | HC Isotype | LC Isotype | VHAA sequence | VLAA sequence | Heavy Chain AA sequence | Light Chain AA sequence |
|---|---|---|---|---|---|---|---|
| | | | | | CQQFGSSPFTF GPGTKVDIK | | |
| | | | | 2343 | 2344 | 2345 | 2346 |
| 6 | 75110_01G11A | IgG1 | Kappa | EVQLVESGGGLVQPGG SLRLSCAASGFTFSSY DMHWVRQATGKGLEWV STIGTAGDTYYPGSVK GRFTISRENARNSLFL QMNSLRAGDTAVYYCA RGGDYYYGMDVWGQGT TVTVSS | EIVLTQSPGTL SLFPGERATLS CRASQNTYSSY LAWYQQKPGQA PRLLIYGASNR ATGIPDRFSGS GSGTDFTLTIS RLEPEDFAVYY CQQHGTSPFTF GPGTKVDIK | N/A | N/A |
| | | | | 2377 | 2378 | 2379 | 2380 |
| 7 | 75110_01H18A | IgG1 | Kappa | QVQLQQWGAGLLKPSE TLSLTCAVYGGSFSGY YWSWIRQSPGKGLEWI GEINQSGSTNYNPSLK SRVTISVDTSKNQFSL KLSSVTAADTAVYYCA RVINWFDSWGQGTLVT VSS | DIQMTQSPSSV SASVGDRVTIT CRASQGISSWL AWYQQKPGKAP KLLIYAASSFQ SGVPSRFSGSG SGTDFTLTISS LQTEDFATYYC QQANSFPYTFG QGTRLEIK | N/A | N/A |
| | | | | 2411 | 2412 | 2413 | 2414 |
| 8 | 75110_01J09A | IgG1 | Kappa | EVQLVESGGGLVQPGG SLRLSCVASGFTFSSY WMSWVRQAPGKGLEWV ANTKEDGSDKYYVDSV KGRFTICRDNAKNSLY LQMNSLRAEDTAVYYC AREGGQWLALDYWGQG TLVTVSS | DIQMTQSPSSV SASVGDRVTIN CRASQGISSWL AWYQQKPGKAP NLLIFGASSLQ SGVPSRFSGSG FGTDFSLTITT LQPEDFATYHC QQANSFPWTFG QGTKVEIK | EVQLVESGGGLVQP GGSLRLSCVASGFT FSSYWMSWVRQAPG KGLEWVANTKEDGS DKYYVDSVKGRFTI CRDNAKNSLYLQMN SLRAEDTAVYYCAR EGGQWLALDYWGQG TLVTVSSASTKGPS VFPLAPSSKSTSGG TAALGCLVKDYFPE PVTVSWNSGALTSG VHTFPAVLQSSGLY SLSSVVTVPSSSLG TQTYICNVNHKPSN TKVDKKVEPKSCDK THTCPPCPAPEAAG GPSVFLFPPKPKDT LMISRTPEVTCVVV SVSHEDPEVKFNWY VDGVEVHNAKTKPR EEQYNSTYRVVSVL TVLHQDWLNGKEYK CKVSNKALPAPIEK TISKAKGQPREPQV YTLPPSRDELTKNQ VSLTCLVKGFYPSD IAVEWESNGQPENN YKTTPPVLDSDGSF FLYSKLTVDKSRWQ QGNVFSCSVMHEAL HNHYTQKSLSLSPG K | DIQMTQSPSSVSA SVGDRVTINCRAS QGISSWLAWYQQK PGKAPNLLIFGAS SLQSGVPSRFSGS GFGTDFSLTITTL QPEDFATYHCQQA NSFPWTFGQGTKV EIKRTVAAPSVFI FPPSDEQLKSGTA SVVCLLNNFYPRE AKVQWKVDNALQS GNSQESVTEQDSK DSTYSLSSTLTLS KADYEKHKVYACE VTHQGLSSPVTKS FNRGEC |
| | | | | 2445 | 2446 | 2447 | 2448 |
| 9 | 75110_01J17A | IgG1 | Kappa | EVQLVESGGGLVQPGG SLRLSCAASGFTFSSY DMHWVRQGTGKGLEWV STIGTADDTYYPGSVK GRFTISRENAENSLYL QMNSLRAGDTAVYYCA RGGDYYYGMDVWGQGT TVTVSS | EIVLAQSPGTL SLSPGERATLS CRASQSVYISY LAWYQQKPGQA PRLLIYGASSR ATGIPDRFSGS GSGTDFTLTIT RLEPEDFAVYY CQQFGSSPFTF GPGTKVDFK | N/A | N/A |
| | | | | 2479 | 2480 | 2481 | 2482 |

TABLE 11-continued

VH and VL Amino Acid Sequences of CD4 Antibodies

| # | Protein Name | HC Isotype | LC Isotype | VHAA sequence | VLAA sequence | Heavy Chain AA sequence | Light Chain AA sequence |
|---|---|---|---|---|---|---|---|
| 10 | 75110_01K10A | IgG1 | Kappa | EVQLVESGGALVQPGGSLRLSCAASGFTFRNYDMHWVRQATGKGLEWVSTIGTAGDTYYPGSVKGRFTISRENAKNSLYLQMNSLRAGDTAVYYCARGGDYYYGMDVWGQGTTVTVSS | EIVLTQSPDTLSLSPGERATLSCRASQSLSSVYLAWYQQKPGQAPRLLIYGASSRATGIPDRFSGTGSGTDFTLTISRLEPEDFAVYYCQQYGSSPFTFGPGTKVDIK | EVQLVESGGALVQPGGSLRLSCAASGFTFRNYDMHWVRQATGKGLEWVSTIGTAGDTYYPGSVKGRFTISRENAKNSLYLQMNSLRAGDTAVYYCARGGDYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK | EIVLTQSPDTLSLSPGERATLSCRASQSLSSVYLAWYQQKPGQAPRLLIYGASSRATGIPDRFSGTGSGTDFTLTISRLEPEDFAVYYCQQYGSSPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| | | | | 2513 | 2514 | 2515 | 2516 |
| 11 | 75110_01L08A | IgG1 | Kappa | QVQLQESGPGLVKPSETLSLTCTVSGGSISHYYWSWIRQPPGKGLEWIGYIHYSGTTNYNPSLKSRVTISVDTSKNQLSLKLRSVTAADTAVYYCARDQGFSSGGMDVWGQGTTVTVSS | DIQMTQSPSSLSASVGDRVTITCQASQDISNYLNWYQQKPGKAPKLLIYDASNLETGVPSRFSGSGSGTDFTFAISSLQPEDIATYYCQQYDNLPLTFGGGTKVEIK | N/A | N/A |
| | | | | 2547 | 2548 | 2549 | 2550 |
| 12 | 75110_01N04A | IgG1 | Kappa | EVQLVESGGGLVQPGGSLRLSCAASGFTFSNYDMHWVRQATGKGLEWVSTIGTAGDTYYPGSVKGRFTISRENAKNSLYLQMNSLRAGDTAVYYCARGGDFYYGLDVWGQGTTVTVSS | EIMLTQSPGTLSLSPGERATLSCRASQSVSSVYLAWYQQKPGQAPRLLIYGASSRATGIPDRFSGSGSGTDFTLTISRLEPEDFAVYYCQQYGSSPFTFGPGTKVDFK | N/A | N/A |
| | | | | 2581 | 2582 | 2583 | 2584 |
| 13 | 75110_02E08A | IgG1 | Kappa | QVQLQESGPGLVKPSETLSLTCTVSGGSISTYYWTWIRQPAGKGLEWIGRVYTSGDTNYNPSLKSRVAMSLDTSKNQFSLKLSSVTAADTAVYYCARDSGALYSWNYGDAFDIWGQGTMVTVSS | DIQMTQSPSAMSASVGDRVTITCRASQDISNYLAWFQQKPGKVPKRLIYAASSLQSGVPSRFSGSGSGTEFTLTISSLQPEDFATYYCLQHNSYPRTFGQGTKVEIK | N/A | N/A |
| | | | | 2615 | 2616 | 2617 | 2618 |
| 14 | 75110_02E22A | IgG1 | Kappa | QVQLQESGPGLVKPSETLSLTCTVSGGSISSFYWSWIRQPAGKGLEWI | DIQMTQSPSSLSASVGDRVTITCQASHDISNYL | N/A | N/A |

TABLE 11-continued

VH and VL Amino Acid Sequences of CD4 Antibodies

| # | Protein Name | HC Isotype | LC Isotype | VHAA sequence | VLAA sequence | Heavy Chain AA sequence | Light Chain AA sequence |
|---|---|---|---|---|---|---|---|
| | | | | GRIYTSGSTNYNPSLK SRVTMSVDTSKNQFSL KLSSVTAADTAVYYCA RELEKRNYYGMDVWGQ GTTVTSS | NWYQQKPGKAP KLLIFDASTLE TGVPSRFSGSG SGTYFTFTIRS LQPEDIATYYC QQYDSLPLTFG GGTKVEIK | | |
| | | | | 2649 | 2650 | 2651 | 2652 |
| 15 | 75110_02I16A | IgG1 | Kappa | QVQLQQWGAGLLKPSE TLSLTCDVYGGSFSGY YWTWIRQPPGKGLEWI GEINHSGTTNSNPSLK SRVTISVDTSKSQFSL RLSSVTAADTAVYFCT RELNWFDPWGQGTLVT VSS | DIQMTQSPSSV SASVGDRVTIT CRASQDIANWL AWYQQKPGKAP QLLIYAASSLL GGVPSRFSGSG SGADFTLTISS LHPEDFATYYC QQANSFPYTFG QGTKLEIK | N/A | N/A |
| | | | | 2683 | 2684 | 2685 | 2686 |
| 16 | 75110_02I18A | IgG1 | Kappa | EVQVVESGGGLVQPGG SLRLSCAASGFTFSSY DMHWVRQATGKGLEWV STIGTAGDTYYPGSVK GRFTISRENAKNSLYL QMNSLRAGDTAVYYCA RGGYYYYGMDVWGQGT TVTVSS | EIVLTQSPGTL SLSPGERATLS CRASQSVSSSY LAWYQQKPGQS PRLLIHGASSR ATGIPDRVSGS GSGTDFTLTIS RLEPEDFAVYY CQQYGSSPFTF GPGTKVDIK | N/A | N/A |
| | | | | 2717 | 2718 | 2719 | 2720 |
| 17 | 75110_02K11A | IgG1 | Kappa | QVQLQESGPGLVKPSQ TLSLTCTVSGGSISSG FYYWTWIRQHPGKGLE WIGYISYSGNTYYNPS FKSRLTISVDTSKSQF SLKLSSVTAADTAVYY CARDRPSNFDAFDIWG QGTMVTVSS | EIVLTQSPGTL SLSPGEGATLS CRASQSVSTSY LAWYQQKPGQA PRLLIYGASSR ATGIPDRFSGS GSGTDFTLTIS RLEPEDFAVYY CQQYGRSPLTF GPGTKVDIK | N/A | N/A |
| | | | | 2751 | 2752 | 2753 | 2754 |
| 18 | 75110_02N15A | IgG1 | Kappa | EVQLVESGGGLVQPGG SLRLSCAASGFTFSSY WMSWVRQAPGKGLEWV ANINEDGNEKYYVDSV KGRFTISRDNAKNSLF LQMNSLRAEDTAVYFC AREGGQWLALDHWGQG ALVTVSS | DIQMTQSPSSV SASVGDRVTIT CRASQGISSWL AWYQQKPGKAP KFLISGASSLQ SGVPSRFSGSG SGTDFTLTISS LQPEDFATYYC QQANSFPWTFG QGTKVEFK | N/A | N/A |
| | | | | 2785 | 2786 | 2787 | 2788 |
| 19 | 75110_03B16A | IgG1 | Kappa | EVQLVESGGGLVQPGG SLRLSCAASGFTFSSY WMSWVRQAPGKGLEWV ANINEDGSEKNYVDSV KGRFTISRDNAKNSLC LQLNSLRAEDTAVYHC AREGGQWLALDYWGQG TLVTVSS | DIQMTQSPSSV SASVGDRVNIT CRASQGIRSWL AWYQQKPGKTP KLLICGASSLQ SGVPSRFSGSG SGTDFTLTISS LQPEDFATYYC QQANSFPWTFG QGTTVEIK | N/A | N/A |
| | | | | 2819 | 2820 | 2821 | 2822 |
| 20 | 75110_03C01A | IgG1 | Kappa | QVQLQQWGAGLLKPSE TLSLTCAVYGGSFSGY YWSWIRQSPGKGLEWI GEINQSGSTNYNPSLK SRVTISVDTSKDQFSL | DIQMTQSPSSV SASVGDRVTIT CRASQGISSWL AWYQQKPGNAP KLLIYDASSFQ | N/A | N/A |

TABLE 11-continued

VH and VL Amino Acid Sequences of CD4 Antibodies

| # | Protein Name | HC Isotype | LC Isotype | VHAA sequence | VLAA sequence | Heavy Chain AA sequence | Light Chain AA sequence |
|---|---|---|---|---|---|---|---|
| | | | | KLSSVTAADTAVYYCA RVINWFDSWGQGSLVT VSS | SGVPSRFSGSG SGTDFTLTISS LQTEDFATYYC QQANSFPYTFG QGTKLEIK | | |
| | | | | 2853 | 2854 | 2855 | 2856 |
| 21 | 75110_03D16A | IgG1 | Kappa | EVQLVESGGGLVQPGG SLRLSCAASGFTFSSY WMSWVRQAPGKGLEWV ANINQDGGEKYYVDSV KGRFTISRDNAKNSLY LQMNSLRAEDTAVYYC VREGGQWLALDYWGQG TLVTVSS | DIQMTQSPSSV SASVGDRVTIT CRASQGISSWL TWYQQKPGKAP KFLIYAASSLQ SGVPSRFSGSG FGTDFTLTISS LQPEDFATYYC QQANSFPWTFG QGTKVEIK | N/A | N/A |
| | | | | 2887 | 2888 | 2889 | 2890 |
| 22 | 75110_03I08A | IgG1 | Kappa | QVQLQESGPGLVKPSE TLSLTCTVSGGSISSY YWSWIRQPPGKGLEWI GYIYYSGSTNYNPSLK SRVTISVDTSKNQFSL KLSSVTAADTAVYYCA REGEQWFYGLDVWGQG TTVTVSS | EIVLTQSPGTL SLSPGERATLS CRASQSVSSTY LAWYQQKPGQA PRLLIYGSSSR ATGIPDRFSGS GSGTDFTLTIS RLEPEDFAVYY CQQYGNSFPIT FGQGTRLEIK | N/A | N/A |
| | | | | 2921 | 2922 | 2923 | 2924 |
| 23 | 75110_03I23A | IgG1 | Kappa | QVQLQESGPGLVKPSE TLSLTCTASGGSITSY YWNWIRQPAGKGLEWI GRIYTSGSTNYNPSLK SRVTMSVDTSKNQFSL KLSSVTAADTAVYYCA RDPGYSDAFNIWGQGT MVTVSS | DIQMTQSPSSL SASVGDRVTIT CQASQDISNYL NWYQQKPGKAP KLLIYDASNLE TGVPSRFSGSG SGTDFTFAISS LQPEDIATYYC QQCDNLPLTFG GGTKVEIK | N/A | N/A |
| | | | | 2955 | 2956 | 2957 | 2958 |
| 24 | 75110_03L12A | IgG1 | Kappa | QVQLQQWGAGLLKPSE TLSLTCAVYGGSFSGY YWSWIRQPPGKGLEWI GEINHSGSTNYNPSLK SRVTISVDTSENQFSL TLISVTAADTAVYYCV RLINWFDPWGQGTLVT VSS | DIQMTQSPSSV SASVGDRVTIT CRASQDISNWL AWYQQKPGKAP KLLIFAASSLQ SGVPSRFSGSG SGTDFTLTISS LQPDDFATYYC QQANSFPYTFG QGTNLGIK | QVQLQQWGAGLLKP SETLSLTCAVYGGS FSGYYWSIRQPPG KGLEWIGEINHSGS TNYNPSLKSRVTIS VDTSENQFSLTLIS VTAADTAVYYCVRL INWFDPWGQGTLVT VSSASTKGPSVFPL APSSKSTSGGTAAL GCLVKDYFPEPVTV SWNSGALTSGVHTF PAVLQSSGLYSLSS VVTVPSSSLGTQTY ICNVNHKPSNTKVD KKVEPKSCDKTHTC PPCPAPEAAGGPSV FLFPPKPKDTLMIS RTPEVTCVVVSVSH EDPEVKFNWYVDGV EVHNAKTKPREEQY NSTYRVVSVLTVLH QDWLNGKEYKCKVS NKALPAPIEKTISK AKGQPREPQVYTLP PSRDELTKNQVSLT CLVKGFYPSDIAVE WESNGQPENNYKTT PPVLDSDGSFFLYS | DIQMTQSPSSVSA SVGDRVTITCRAS QDISNWLAWYQQK PGKAPKLLIFAAS SLQSGVPSRFSGS GSGTDFTLTISSL QPDDFATYYCQQA NSFPYTFGQGTNL GIKRTVAAPSVFI FPPSDEQLKSGTA SVVCLLNNFYPRE AKVQWKVDNALQS GNSQESVTEQDSK DSTYSLSSTLTLS KADYEKHKVYACE VTHQGLSSPVTKS FNRGEC |

TABLE 11-continued

VH and VL Amino Acid Sequences of CD4 Antibodies

| # | Protein Name | HC Isotype | LC Isotype | VH AA sequence | VL AA sequence | Heavy Chain AA sequence | Light Chain AA sequence |
|---|---|---|---|---|---|---|---|
| | | | | | | KLTVDKSRWQQGNV FSCSVMHEALHNHY TQKSLSLSPGK | |
| | | | | 2989 | 2990 | 2991 | 2992 |
| 25 | 75110_04B08A | IgG1 | Kappa | QVQLVESGGGVVQPGR SLRLSCTASGFNFINY GIHWVRQAPGKGLEWV TIIWYDGSKKYYADSV KGRFAISRDNSKNTLY LQMNSLRAEDTAVYYC AREDDWNDGLAYWGQG TLVTVSS | AIQMTQSPSSL SASVGDRVTIT CRASQDIRNDL GWYQQKPGKAP NLLIYAASNLQ SGVPSRFSGSG SGTDFTLTISS LQPEDFATYYC LQDSNYPRTFG QGTKVEIK | QVQLVESGGGVVQP GRSLRLSCTASGFN FINYGIHWVRQAPG KGLEWVTIIWYDGS KKYYADSVKGRFAI SRDNSKNTLYLQMN SLRAEDTAVYYCAR EDDWNDGLAYWGQG TLVTVSSASTKGPS VFPLAPSSKSTSGG TAALGCLVKDYFPE PVTVSWNSGALTSG VHTFPAVLQSSGLY SLSSVVTVPSSSLG TQTYICNVNHKPSN TKVDKKVEPKSCDK THTCPPCPAPEAAG GPSVFLFPPKPKDT LMISRTPEVTCVVV SVSHEDPEVKFNWY VDGVEVHNAKTKPR EEQYNSTYRVVSVL TVLHQDWLNGKEYK CKVSNKALPAPIEK TISKAKGQPREPQV YTLPPSRDELTKNQ VSLTCLVKGFYPSD IAVEWESNGQPENN YKTTPPVLDSDGSF FLYSKLTVDKSRWQ QGNVFSCSVMHEAL HNHYTQKSLSLSPG K | AIQMTQSPSSLSA SVGDRVTITCRAS QDIRNDLGWYQQK PGKAPNLLIYAAS NLQSGVPSRFSGS GSGTDFTLTISSL QPEDFATYYCLQD SNYPRTFGQGTKV EIKRTVAAPSVFI FPPSDEQLKSGTA SVVCLLNNFYPRE AKVQWKVDNALQS GNSQESVTEQDSK DSTYSLSSTLTLS KADYEKHKVYACE VTHQGLSSPVTKS FNRGEC |
| | | | | 3023 | 3024 | 3025 | 3026 |
| 26 | 75110_04D20A | IgG1 | Kappa | QVQLQESGPGLVKPSE TLSLTCTVSNGSISDY YWSWIRQPAGKGLEWI GRIYTSGSTNYNPSLK SRITMSVDTSKNQFSL ELSSVTAADTAVYYCA RELERYYFYGVDVWGQ GTTVTVSS | DIQMTQSPSSL SASVGDRVTIT CQASQDISNYL NWYQQKPGKAP KLLIYAASNLE TGVPSRFSGSG SGTDFTFTISS LQPEDIATYYC QQYDSLPLTFG GGTKVEIK | N/A | N/A |
| | | | | 3057 | 3058 | 3059 | 3060 |
| 27 | 75110_04F22A | IgG1 | Kappa | EVQLVESGGGLVQPGG SLRLSCAASGFTSSY DIHWVRQATGKGLEWV STIGTAGDTYYPGSVK GRFTISRENAKNSLYL QMNSLRAGDTAVYYCA RGGYYYYGMDVWGQGT TVTVSS | EIVLTQSPGTL SLSPGERATLS CRASQSVYSSY LAWYQQKPGQA PRLLIYGASSR ATGIPDRFSGS GSGTDFTLTIS RLEPEDFAVYY CQQFGTSPFTF GPGTKVDIK | EVQLVESGGGLVQP GGSLRLSCAASGFT FSSYDIHWVRQATG KGLEWVSTIGTAGD TYYPGSVKGRFTIS RENAKNSLYLQMNS LRAGDTAVYYCARG GYYYYGMDVWGQGT TVTVSSASTKGPSV FPLAPSSKSTSGGT AALGCLVKDYFPEP VTVSWNSGALTSGV HTFPAVLQSSGLYS LSSVVTVPSSSLGT QTYICNVNHKPSNT KVDKKVEPKSCDKT HTCPPCPAPEAAGG PSVFLFPPKPKDTL MISRTPEVTCVVVS VSHEDPEVKFNWYV DGVEVHNAKTKPRE EQYNSTYRVVSVLT | EIVLTQSPGTLSL SPGERATLSCRAS QSVYSSYLAWYQQ KPGQAPRLLIYGA SSRATGIPDRFSG SGSGTDFTLTISR LEPEDFAVYYCQQ FGTSPFTFGPGTK VDIKRTVAAPSVF IFPPSDEQLKSGT ASVVCLLNNFYPR EAKVQWKVDNALQ SGNSQESVTEQDS KDSTYSLSSTLTL SKADYEKHKVYAC EVTHQGLSSPVTK SFNRGEC |

TABLE 11-continued

VH and VL Amino Acid Sequences of CD4 Antibodies

| # | Protein Name | HC Isotype | LC Isotype | VHAA sequence | VLAA sequence | Heavy Chain AA sequence | Light Chain AA sequence |
|---|---|---|---|---|---|---|---|
| | | | | | | VLHQDWLNGKEYKC KVSNKALPAPIEKT ISKAKGQPREPQVY TLPPSRDELTKNQV SLTCLVKGFYPSDI AVEWESNGQPENNY KTTPPVLDSDGSFF LYSKLTVDKSRWQQ GNVFSCSVMHEALH NHYTQKSLSLSPGK | |
| | | | | 3091 | 3092 | 3093 | 3094 |
| 28 | 75110_04G02A | IgG1 | Kappa | EVQLVESGGGLVKPGG SLRLSCAASGFTFSNA WMSWVRQAPGKGLEWV GRIKSKTDGGTTDYAA PVKGRFTISRDDSKNT LYLQMNSLKTEDTAVY YCTTGGWFGELWGPFD IWGQGTMVTVSS | DIVMTQSPDSL AVSLGERATIN CKSSQSVLYSS NNKNYLAWYQQ KPGQPPKLLFY WASARESGVPD RFSGSGSGTDF TLTISSLQAED VALYYCQQYFG SFPTFGQGTKL EIK | N/A | N/A |
| | | | | 3125 | 3126 | 3127 | 3128 |
| 29 | 75110_04G16A | IgG1 | Kappa | QVQLQESGPGLVKPSQ TLSLTCTVSGDSISSG YYYWSWIRQHPGKGLE WIGYISYSGSTYYNPS LKSRLTISVNTSKNQF SLKLSSLTAADTAVYY CARDRPSNFDAFDIWG QGTMVTVSS | EIVLTQSPGTL SLSPGERATLS CRASQSVGSTY LAWYQQKPGQA PRLLIYGAFSR ATGIPDRFSGS GSGTDFTLTIS RLEPEDFAVYY CQQYGSSPLTF GPGTKVDIK | QVQLQESGPGLVKP SQTLSLTCTVSGDS ISSGYYYWSWIRQH PGKGLEWIGYISYS GSTYYNPSLKSRLT ISVNTSKNQFSLKL SSLTAADTAVYYCA RDRPSNFDAFDIWG QGTMVTVSSASTKG PSVFPLAPSSKSTS GGTAALGCLVKDYF PEPVTVSWNSGALT SGVHTFPAVLQSSG LYSLSSVVTVPSSS LGTQTYICNVNHKP SNTKVDKKVEPKSC DKTHTCPPCPAPEA AGGPSVFLFPPKPK DTLMISRTPEVTCV VVSVSHEDPEVKFN WYVDGVEVHNAKTK PREEQYNSTYRVVS VLTVLHQDWLNGKE YKCKVSNKALPAPI EKTISKAKGQPREP QVYTLPPSRDELTK NQVSLTCLVKGFYP SDIAVEWESNGQPE NNYKTTPPVLDSDG SFFLYSKLTVDKSR WQQGNVFSCSVMHE ALHNHYTQKSLSLS PGK | EIVLTQSPGTLSL SPGERATLSCRAS QSVGSTYLAWYQQ KPGQAPRLLIYGA FSRATGIPDRFSG SGSGTDFTLTISR LEPEDFAVYYCQQ YGSSPLTFGPGTK VDIKRTVAAPSVF IFPPSDEQLKSGT ASVVCLLNNFYPR EAKVQWKVDNALQ SGNSQESVTEQDS KDSTYSLSSTLTL SKADYEKHKVYAC EVTHQGLSSPVTK SFNRGEC |
| | | | | 3159 | 3160 | 3161 | 3162 |
| 30 | 75110_04H17A | IgG1 | Kappa | QVQLQESGPGLVKPSE TLSLTCTVSGGSISTY YWSWIRQSAGKGLEWI GRIYTSERPNYNPSLK SRVTMSVDTSKNQFSL KLNSVSAADTAVYYCA RELERPYYYGMDVWGQ GTTVTVSS | DVQMTQSPSSL SASVGGRVTIT CQASQDISNYL NWYQQKPGKAP KLLIYYASNLE TGVPSRFSGSG SGTDFTFTISS LQPEDFATYYC QQYDNLPLTFG GGTKVEIK | N/A | N/A |
| | | | | 3193 | 3194 | 3195 | 3196 |

TABLE 11-continued

VH and VL Amino Acid Sequences of CD4 Antibodies

| # | Protein Name | HC Isotype | LC Isotype | VHAA sequence | VLAA sequence | Heavy Chain AA sequence | Light Chain AA sequence |
|---|---|---|---|---|---|---|---|
| 31 | 75110_04K10A | IgG1 | Kappa | EVQLVESGGGLVQPGG SLRLSCAASGFTFSSY WMSWVRQAPGKGLEWV ANINQDGSEKYYVDSV KGRFTISRDNAKNSLY LQLNSLRAEDTAMYYC AREGGQWLSLDYWGQG TLVTVSS | DIQMTQSPSSV SASVGDRVTIT CRASQGISSWL AWYQQKPGKAP KVLIYGVSSFQ SGVPSRFSGSG SGTDFILTISS LQPEDFATYYC QQANSFPWTFG QGTKVEIK | N/A | N/A |
|  |  |  |  | 3227 | 3228 | 3229 | 3230 |
| 32 | 75110_04P06A | IgG1 | Kappa | EVQLVESGGGLVQPGG SLRLSCAASGFTFSNY DMHWVRQATGKGLEWV STIGTAGDTYYPGSVK GRFTISRENAKNSLYL QMNSLRAGDTAVYYCA RGGDYYYGMDVWGQGT TVTVSS | EIVLTQSPDTL SLSPGERATLS CRASQSLSSVY LAWYQQKPGQA PRLLIYGASSR ATGIPDRFSGS GSGTDFTLTIN RLEPEDFVVYY CQQYGSSPFTF GPGTKVDIK | N/A | N/A |
|  |  |  |  | 3261 | 3262 | 3263 | 3264 |
| 33 | 75110_04P08A | IgG1 | Kappa | QVQLQQWGAGLLKPSE TLSLTCAVYGGSLSGY YWSWIRQSPGKGLEWI GEINQSGSTNYNPSLK SRVTISVDTSKDQFSL RLTSVTAADTAVYYCT RVLNWFDPWGRGTLVT VSS | DIQMTQSPSSV SASVGDRVTLT CRASQDISNWL AWYQQKPGKAP KLLIYAASSLQ SGVPSRFSGSG SGTDFTLTISS LQTEDFATYYC QQANSFPYTFG QGTKLEIK | QVQLQQWGAGLLKP SETLSLTCAVYGGS LSGYYWSWIRQSPG KGLEWIGEINQSGS TNYNPSLKSRVTIS VDTSKDQFSLRLTS VTAADTAVYYCTRV LNWFDPWGRGTLVT VSSASTKGPSVFPL APSSKSTSGGTAAL GCLVKDYFPEPVTV SWNSGALTSGVHTF PAVLQSSGLYSLSS VVTVPSSSLGTQTY ICNVNHKPSNTKVD KKVEPKSCDKTHTC PPCPAPEAAGGPSV FLFPPKPKDTLMIS RTPEVTCVVVSVSH EDPEVKFNWYVDGV EVHNAKTKPREEQY NSTYRVVSVLTVLH QDWLNGKEYKCKVS NKALPAPIEKTISK AKGQPREPQVYTLP PSRDELTKNQVSLT CLVKGFYPSDIAVE WESNGQPENNYKTT PPVLDSDGSFFLYS KLTVDKSRWQQGNV FSCSVMHEALHNHY TQKSLSLSPGK | DIQMTQSPSSVSA SVGDRVTLTCRAS QDISNWLAWYQQK PGKAPKLLIYAAS SLQSGVPSRFSGS GSGTDFTLTISSL QTEDFATYYCQQA NSFPYTFGQGTKL EIKRTVAAPSVFI FPPSDEQLKSGTA SVVCLLNNFYPRE AKVQWKVDNALQS GNSQESVTEQDSK DSTYSLSSTLTLS KADYEKHKVYACE VTHQGLSSPVTKS FNRGEC |
|  |  |  |  | 3295 | 3296 | 3297 | 3298 |
| 34 | 75110_05A11A | IgG1 | Kappa | EVQLVESGGGLVKPGG SLTLSCAASGFTFSNT WMSWVRQAPGKGLEWV GRIKSKIDGGTTDYAA PVKGRFTISRDDSKNT LYLQMNSLKTEDTAVY YCTTSGTYSSWGLFD YWGQGTLVTVSS | DIQMTQSPSSL SASVGDRVTIT CQASQDISNYL NWYQQKPGKAP KLLIYDTSNLE AGVPSRFSGSG SGTHFTLTISS LQPEDIATYYC QQYDNLPFTFG GGTRVEIK | N/A | N/A |
|  |  |  |  | 3329 | 3330 | 3331 | 3332 |
| 35 | 75110_05B13A | IgG1 | Kappa | QVLLEQWGAGLLKPSE TLSLTCAVYGGSFSGY YWTWIRQPPGKGLEWI | DIQMTQSPSSV SASVGDRVTIT CRASQDISNWL | N/A | N/A |

TABLE 11-continued

VH and VL Amino Acid Sequences of CD4 Antibodies

| # | Protein Name | HC Isotype | LC Isotype | VHAA sequence | VLAA sequence | Heavy Chain AA sequence | Light Chain AA sequence |
|---|---|---|---|---|---|---|---|
| | | | | GEINHRGSTNYNPSLK SRVTISIDTSKNQFSL KVKSVTAADTAMYYCT RPDSNWFDPWGQGTLV TVSS | AWYQQKPGKAP KLLIFAASSLQ SGVPSRFSGSG SGTDFTLTISS LQPEDFATYYC QQANSFPLTFG GGTKVEIK | | |
| | | | | 3363 | 3364 | 3365 | 3366 |
| 36 | 75110_05E05A | IgG1 | Kappa | QVQLQESGPGLVKPSE TLSLTCTVSGGSIGSY YWSWIRQPAGKGLEWI GRIYTSGSTNYNPSLK SRVTMSFDTSKNQFSL KLNSVTAADTAVYYCA TDGGVGDSLDYWGQGT LVTVSS | DIVMTQTPLSL PVTPGEPASIS CRSSQSLLDSD DGNTYLDWYLQ KPGQSPQLLIY TLSYRASGVPD RFSGSGSGTDF TLKISRVEAED VGVYYCMQHIE FPFTFGPGTKV DIK | QVQLQESGPGLVKP SETLSLTCTVSGGS IGSYYWSWIRQPAG KGLEWIGRIYTSGS TNYNPSLKSRVTMS FDTSKNQFSLKLNS VTAADTAVYYCATD GGVGDSLDYWGQGT LVTVSSASTKGPSV FPLAPSSKSTSGGT AALGCLVKDYFPEP VTVSWNSGALTSGV HTFPAVLQSSGLYS LSSVVTVPSSSLGT QTYICNVNHKPSNT KVDKKVEPKSCDKT HTCPPCPAPEAAGG PSVFLFPPKPKDTL MISRTPEVTCVVVS VSHEDPEVKFNWYV DGVEVHNAKTKPRE EQYNSTYRVVSVLT VLHQDWLNGKEYKC KVSNKALPAPIEKT ISKAKGQPREPQVY TLPPSRDELTKNQV SLTCLVKGFYPSDI AVEWESNGQPENNY KTTPPVLDSDGSFF LYSKLTVDKSRWQQ GNVFSCSVMHEALH NHYTQKSLSLSPGK | DIVMTQTPLSLPV TPGEPASISCRSS QSLLDSDDGNTYL DWYLQKPGQSPQL LIYTLSYRASGVP DRFSGSGSGTDFT LKISRVEAEDVGV YYCMQHIEFPFTF GPGTKVDIKRTVA APSVFIFPPSDEQ LKSGTASVVCLLN NFYPREAKVQWKV DNALQSGNSQESV TEQDSKDSTYSLS STLTLSKADYEKH KVYACEVTHQGLS SPVTKSFNRGEC |
| | | | | 3397 | 3398 | 3399 | 3400 |
| 37 | 75110_05E13A | IgG1 | Kappa | EVQLVESGGDLVKPGG SLRLSCAASGFSFSNA WMSWVRQAPGKGLEWV GRVESKTDGGTTDYAA PVKDRFTISRDDSKYT LYLQMNSLKTEDSAVY YCTIGGGFGLELYGFF DYWGQGTLVTVSS | DIQMTQSPSTL SASVGDRVTIT CRASQSISSWL AWYQQKPGKAP MLLIYKASSLE SGVPSRFSGSG SGTEFTLTISS LQPDDFATYYC LQYNSYYTFGQ GTKLEIK | N/A | N/A |
| | | | | 3431 | 3432 | 3433 | 3434 |
| 38 | 75110_05F19A | IgG1 | Kappa | EVQLVESGGGLVQPGG SLRLSCAASGFTFSNY DVHWVRQPTGKGLEWV STIGTAGDTYYPGSVK GRFTISRENAKNSLYL QMNSLRAGDTAVYYCA RGGYDYYGLDVWGQGT TVTVSS | EIVLTQSPGTL SLSPGERATLS CRASQSVSSTY LAWYQQKPGQA PRLLIFGASSR ATGIPDRFSGS GSGTDFTLTIS RLEPEDFAVYY CQQYGSSPFTF GPGTKVDIK | N/A | N/A |
| | | | | 3465 | 3466 | 3467 | 3468 |
| 39 | 75110_05G15A | IgG1 | Kappa | QVQLQESGPGLVKPSQ TLSLTCTVSGGSISSG GYFWSWIRQHPGKGLE WIGCIYYSGSTYYIPS LKSRVTISDTSKNQF | EIVLTQSPGTL SLSPGERATLS CRASQSVSSSY LAWYQQKPGQA PRLLIYGASSR | N/A | N/A |

TABLE 11-continued

VH and VL Amino Acid Sequences of CD4 Antibodies

| # | Protein Name | HC Isotype | LC Isotype | VHAA sequence | VLAA sequence | Heavy Chain AA sequence | Light Chain AA sequence |
|---|---|---|---|---|---|---|---|
| | | | | SLKLRSVTAADTAVYY CARDGYDYWYFDLWGR GTLVTVSS 3499 | ATGIPDRFSGS GSGTDFTLTIS RLEPEDFAVYY CQQYGSSPYTF GQGTKLEIK 3500 | 3501 | 3502 |
| 40 | 75110_05K11A | IgG1 | Kappa | EVQLVESGGGLVQPGG SLRLSCAASGFTFSSY DMHWVRQPTGKGLEWV STIGTAGDTYYPASVK GRFTISRENAKNSLYL QMNSLRAGDTAVYYCA RGGFYYYGMDVWGQGT TVTVSS 3533 | EIVLTQSPGTL SLSPGERVTLS CRASQSVSNTY LAWYQQKPGQA PRLLIYGASSR ATGIPDRFSGS GSGTDFTLTIS RLEPEDFVVYY CQQHGSSPFTF GPGTKVDIK 3534 | N/A 3535 | N/A 3536 |
| 41 | 75110_05L07A | IgG1 | Kappa | EVQLVESGGGLVQPGG SLRLSCAASGFTFSSY WMSWVRQAPGKGLEWV ANINQDGSDKYYVDSV KGRFTISRDNVKNSLY LQINSLRAEDTAVYYC AREGGQWLTLDYWGQG TLVTVSS 3567 | EIVLTQSPGTL SLSPGERATLS CRASQSVSSTY LAWYQQKPGQA PRLLIFGASSR ATGIPDRFSGS GSGTDFTLTIS RLEPEDFAVYY CQQYGSSPFTF GPGTKVDIK 3568 | N/A 3569 | N/A 3570 |
| 42 | 75110_06C16A | IgG1 | Kappa | QVQLQESGPGLVTPSE TLSLSCTVSGGSISDY YWSWIRQPGGKGLEWI GRIYSSGSTNYNPSLK SRVTMSVDTSKNQFSL KLSSVTAADTAVYFCA RDREDYYYYGMDVWGQ GTTVTVSS 3601 | DIQMTQSPSSL SASVGDRVTIT CQASHDISNYL NWYQQKPGKAP KLLIYAASNLE TGVPSRFSGSG SGTDFSFTISS LQPEDIATYYC QQYDHLPLTFG GGTKVEIK 3602 | N/A 3603 | N/A 3604 |
| 43 | 75110_06D16A | IgG1 | Kappa | QVQLQQWGAGLLKPSE TLSLTCAVYGGSFSGY YWSWIRQPPGKGLEWI GEINHSGSTNYNPSLK SRVTISVVTSKNQFSL KLSSVTAADTAVYYCA RVLNWFDPWGQGTLVT VSS 3635 | DIQMTQSPSSV SASVGDRVTIT CRASQDIADWL AWYQQKPGKAP KLLIYAASSFQ SGVPSRFSGSG SGTDFTLTISS LQPEDFATYFC QQANSFPYTFG QGTKLEIK 3636 | N/A 3637 | N/A 3638 |
| 44 | 75110_06E14A | IgG1 | Kappa | QVQLQESGPGLVKPSE TLSLTCTVSGGSISNY FWSWIRQPAGKGLEWI GRIYSSGNTNYNPSLK SRVTMSVDTSKNQFSL KLSSVTAADTAVYYCA RDREDYYYYGMDVWGQ GTTVTVSS 3669 | DIQMTQSPSSL SASVGDRVTIT CQASQDISNYL NWYQQKPGKAP KLLIYGASILE TGVPSRFTGSG SGTDFTFTISS LQPEDIATYYC QQYDSLPITFG QGTRLEIK 3670 | N/A 3671 | N/A 3672 |
| 45 | 75110_06G04A | IgG1 | Kappa | QVQLLESGPGLVKPSE TLSLTCTVSGGSISSY YWSWIRQPAGKGLEWI GRIYISGSTNYNPSLK SRVTMSIDTSENQFSL NLSSVTAADTAVYYCA | DIQMTQSPSSL SASVGDRVTIT CQASQDISNYL NWYQQKPGKAP KLLIYNASTLE TGVPSRFSGSG | | |

TABLE 11-continued

VH and VL Amino Acid Sequences of CD4 Antibodies

| # | Protein Name | HC Isotype | LC Isotype | VHAA sequence | VLAA sequence | Heavy Chain AA sequence | Light Chain AA sequence |
|---|---|---|---|---|---|---|---|
| | | | | RELERPYYYGMDVWGQ GTTVTVSS | SGTDFTFTISS LQPEDIATYYC QQYDNLPLTFG GGTKVEFK | | |
| | | | | 3703 | 3704 | 3705 | 3706 |
| 46 | 75110_06K03A | IgG1 | Kappa | QVQLQESGPGLVKPSE TLSLTCTVSGGSISTY YWSWIRQPAGKGLEWI GRINTSGSTTYNPSLK SRVTMSVDTSKNQFSL KLSSVTAADTAVYYCA RELERYYYYGMDVWGQ GTTVTVSS | DIQMTQSPSSL SASVGDRVTIT CQASQDISNYL NWYQQKPGKAP KLLIYYASILE TGVPSRFSGSG SGTDFTFTISS LQPEDIATYYC QQYDSLPLTFG GGTKVEIK | N/A | N/A |
| | | | | 3737 | 3738 | 3739 | 3740 |
| 47 | 75110_07B16A | IgG1 | Kappa | QVQLQQWGAGLLKPSE TLSLTCAVYGGSFSGY YWSWIRQSPGKGLEWI GEINQSGSTNYNPSLK SRVTISVDTSKDQFSL KLSSVTAADTAVYYCA RVINWFDSWGQGSLVT VSS | DIQMTQSPSSV SASVGDRVTIT CRASQGISSWL AWYQQKPGKAP KLLIYDASSFQ SGVPSRFSGSG SGTDFTLTISS LQTDDFATYYC QQANSFPYTFG QGTKLEIK | N/A | N/A |
| | | | | 3771 | 3772 | 3773 | 3774 |
| 48 | 75110_07E04A | IgG1 | Kappa | EVQLVESGGGLVQPGG SLRLSCAVSGFTFSSY DMHWVRQATGKGLEWV STIGTAGDTYYPGSVK GRFTISRENAKKFLYL QMNSLRAGDTAVYYCA RGGYYYYGMDVWGQGT TVTVSS | EIVLTQSPGTL SLSPGERATLS CRASQSISSTY LAWYQQKPGQA PRLLIYGASSR ATGIPDRFSGS GSGTDFTLTIS RLEPEDFAVYY CQQYGSSPFTF GPGTKVDIK | N/A | N/A |
| | | | | 3805 | 3806 | 3807 | 3808 |
| 49 | 75110_07H07A | IgG1 | Kappa | EVQVVESGGGLVQPGG SLRLSCAASGFTFSSY WMSWVRQAPGKGLEWV ANIKEEGSEKYYVDSV KGRFTISRDNAKNSLY LQMNSLRAEDTAVYYC VREGGQWLALDYWGQG TLVTVSS | DIQMTQSPSSV SGSVGDRVTIT CRASQGISSWL AWYQQKPGKAP KLLIFGASSLQ SGVPSRFSGSG SGTDFTLTISS LQPEDFATYYC QQANSFPWTFG QGTKVQIK | N/A | N/A |
| | | | | 3839 | 3840 | 3841 | 3842 |
| 50 | 75110_07J02A | IgG1 | Kappa | EVQLVESGGGLVQPGG SLRLSCAASGFTFSSY WMSWVRQAPGKGLEWV ANIKEDGSEKYYVDSV KGRFTISRDNAKNSLY LQMNSLRAEDTAVYYC ARDGSYSGYGMDVWGQ GTTVTVSS | AIQMTQSPSSL SASVGDRVTIT CRASQGIRNDL GWYQQKPGKAP KLLIYAASSLQ SGVPSRFSGRG SGTDFALTISS LQPEDFATYYC LLDYNYPYTFG QGTRLEIK | EVQLVESGGGLVQP GGSLRLSCAASGFT FSSYWMSWVRQAPG KGLEWVANIKEDGS EKYYVDSVKGRFTI SRDNAKNSLYLQMN SLRAEDTAVYYCAR DGSYSGYGMDVWGQ GTTVTVSSASTKGP SVFPLAPSSKSTSG GTAALGCLVKDYFP EPVTVSWNSGALTS GVHTFPAVLQSSGL YSLSSVVTVPSSSL GTQTYICNVNHKPS NTKVDKKVEPKSCD KTHTCPPCPAPEAA GGPSVFLFPPKPKD TLMISRTPEVTCVV VSVSHEDPEVKFNW | AIQMTQSPSSLSA SVGDRVTITCRAS QGIRNDLGWYQQK PGKAPKLLIYAAS SLQSGVPSRFSGR GSGTDFALTISSL QPEDFATYYCLLD YNYPYTFGQGTRL EIKRTVAAPSVFI FPPSDEQLKSGTA SVVCLLNNFYPRE AKVQWKVDNALQS GNSQESVTEQDSK DSTYSLSSTLTLS KADYEKHKVYACE VTHQGLSSPVTKS FNRGEC |

TABLE 11-continued

VH and VL Amino Acid Sequences of CD4 Antibodies

| # | Protein Name | HC Isotype | LC Isotype | VHAA sequence | VLAA sequence | Heavy Chain AA sequence | Light Chain AA sequence |
|---|---|---|---|---|---|---|---|
| | | | | | | YVDGVEVHNAKTKP REEQYNSTYRVVSV LTVLHQDWLNGKEY KCKVSNKALPAPIE KTISKAKGQPREPQ VYTLPPSRDELTKN QVSLTCLVKGFYPS DIAVEWESNGQPEN NYKTTPPVLDSDGS FFLYSKLTVDKSRW QQGNVFSCSVMHEA LHNHYTQKSLSLSP GK | |
| | | | | 3873 | 3874 | 3875 | 3876 |
| 51 | 75110_07J24A | IgG1 | Kappa | QAQLQESGPGLVKPSE TLSLTCTVSGGSISSY YYNWIRQPAGKGLEWI GRIYTSGRTDYNPSLK SRVTMSADTSKNQFSL KLSSVTAADTAVYYCA RDEGPTDAFDIWGQGT MVTVSS | DIVMTQTPLSL PVTPGEPASIS CRSSQSLLDSD DGNTYLDWYLQ KPGQSPHLLIY TLSYRASGVPD RFSGSGSGSDF TLKISRVEAED VGVYYCMQRIE FPFTFGPGTKV DIK | N/A | N/A |
| | | | | 3907 | 3908 | 3909 | 3910 |
| 52 | 75110_07N04A | IgG1 | Kappa | QVQLQESGPGLVKPSE TLSLTCSVSGVSSTSF YWSWIRQPAGKGLDWI GRIYTSGSTNYNPSLK SRVTMSVDTSKNQFSL KLSSVTAADTAVYYCA RDPGYSDAFAIWGQGT MVTVSS | DIQMTQSPSSL SASVGDRVTIT CQASQDISNYL TWYQQKPGKAP KLLIYDTSNLE TGVPSRFSGSG SGTDFTFTISS LQPEDIATYYC QQYDNLPLTFG GGTKVEIK | N/A | N/A |
| | | | | 3941 | 3942 | 3943 | 3944 |
| 53 | 75110_08A13A | IgG1 | Kappa | EVQLVESGGGLVQPGG SLRLSCAASGFIFSSY WMSWVRQAPGKGLEWV ANIKQDGSEKYYMDSV KGRFTISRDNAKNSLY LQMNSLRAEDTAVYYC ARDNSYYYYGMDVWGQ GTTVTVSS | AIQMTQSPSSL SASVGDRVTIT CRASQGIRDDL GWYQQKPGKAP KLLIFAASSLQ SGVPSSFSGSG SGTDFTLTISS LQPEDFATYYC LHHYNYPYTFG QGTKLEIK | EVQLVESGGGLVQP GGSLRLSCAASGFI FSSYWMSWVRQAPG KGLEWVANIKQDGS EKYYMDSVKGRFTI SRDNAKNSLYLQMN SLRAEDTAVYYCAR DNSYYYYGMDVWGQ GTTVTVSSASTKGP SVFPLAPSSKSTSG GTAALGCLVKDYFP EPVTVSWNSGALTS GVHTFPAVLQSSGL YSLSSVVTVPSSSL GTQTYICNVNHKPS NTKVDKKVEPKSCD KTHTCPPCPAPEAA GGPSVFLFPPKPKD TLMISRTPEVTCVV VSVSHEDPEVKFNW YVDGVEVHNAKTKP REEQYNSTYRVVSV LTVLHQDWLNGKEY KCKVSNKALPAPIE KTISKAKGQPREPQ VYTLPPSRDELTKN QVSLTCLVKGFYPS DIAVEWESNGQPEN NYKTTPPVLDSDGS FFLYSKLTVDKSRW QQGNVFSCSVMHEA LHNHYTQKSLSLSP GK | AIQMTQSPSSLSA SVGDRVTITCRAS QGIRDDLGWYQQK PGKAPKLLIFAAS SLQSGVPSSFSGS GSGTDFTLTISSL QPEDFATYYCLHH YNYPYTFGQGTKL EIKRTVAAPSVFI FPPSDEQLKSGTA SVVCLLNNFYPRE AKVQWKVDNALQS GNSQESVTEQDSK DSTYSLSSTLTLS KADYEKHKVYACE VTHQGLSSPVTKS FNRGEC |
| | | | | 3975 | 3976 | 3977 | 3978 |

TABLE 11-continued

VH and VL Amino Acid Sequences of CD4 Antibodies

| # | Protein Name | HC Isotype | LC Isotype | VHAA sequence | VLAA sequence | Heavy Chain AA sequence | Light Chain AA sequence |
|---|---|---|---|---|---|---|---|
| 54 | 75110_08D24A | IgG1 | Kappa | QVQLQESGPGLVKPSE TLSLTCTVSGGSISGF YWSWIRQPAGKGLEWI GRIYTSENTNYNPSLK SRVTMSVDTSKNQFSL KLSSVTAADTAVYYCA RDREGYYYYGMDVWGQ GTTVTVSS<br><br>4009 | DIQMTQSPSSL SASVGDRVTIT CQASQDISNYL NWYQQKPGKAP KLLIYAASNLE TGVPSRFSGSG SGTDFTFTISS LQPEDIATYYC QQYDSLPITFG QGTRLEIK<br><br>4010 | N/A<br><br>4011 | N/A<br><br>4012 |
| 55 | 75110_08F20A | IgG1 | Kappa | QVQLQESGPGLVKPSE TLSLTCSVSGGSISTY YWSWIRQPAGKGLEWI GRICTTENTNYNPSLK SRVTMSIDSSKNQFSL KLSSVTAADTAVYYCA RDLERLNYYGMDVWGQ GATVTVSS<br><br>4043 | DIQMTQSPSSL SASVGDRVTIT CQASQDISKYL NWYQQKPGIAP KLLIYDASNLE TGVPSRFSGSG SGTDFTFTISS LQPEDFATYYC QQYDSLPITFG QGTRLEIK<br><br>4044 | N/A<br><br>4045 | N/A<br><br>4046 |
| 56 | 75110_08G08A | IgG1 | Kappa | QVQLQESGPGLVKPSE TLSLTCSVSGGSISTY YWSWIRQPAGKGLEWI GRICTTENTNYNPSLK SRVTMSIDSSKNQFSL KLSSVTAADTAVYYCA RDLERLNYYGMDVWGQ GATVTVSS<br><br>4077 | DIQMTQSPSSL SASVGDRVTIT CQASQDISNYL NWYQQKPGIAP KLLIYDASNLE TGVPSRFSGSG SGTDFTFTISS LQPEDIATYYC QQYDSLPITFG QGTRLEIK<br><br>4078 | N/A<br><br>4079 | N/A<br><br>4080 |
| 57 | 75110_08H06A | IgG1 | Kappa | EVQLVESGGGLVQPGG SLRLSCAASGFTFSNY DMHWVRQATGKGLEWV STIGTAGDTYYPGSVK GRFTISRENAKNSLYL QMNSLRAGDTAVYYCA RGGYDYYGMDVWGQGT TVTVSS<br><br>4111 | EIVLTQSPGTL SLSPGERATLS CRASQSITSIY LAWYRQKPGQA PRLLIYGASSR ATGIPDRFSGS GSGTDFTLTIS RLEPEDFAVYY CQQYGSSPFTF GPGTKVDIK<br><br>4112 | N/A<br><br>4113 | N/A<br><br>4114 |
| 58 | 75110_08H11A | IgG1 | Kappa | EVQLVESGGGLVQPGG SLRLSCAASGFTFSSY DMHWVRQATGKGLEWV STIGTAGDTYYPGSVK GRFTISRENAKNSLYL QMNSLRAGDTAVYYCA RGGYSYYGMDVWGQGT TVTVSS<br><br>4145 | EIVLTQSPGTL SLSPGERATLS CGASQSVSSTY LAWYQQKPGQA PRLLIYGASSR ATGIPDRFSGS GSGTDFTLTIS RLEPEDFAVYY CQQFGSSPFTF GPGTKVDIK<br><br>4146 | N/A<br><br>4147 | N/A<br><br>4148 |
| 59 | 75110_08K12A | IgG1 | Kappa | EVQLVESGGGLVQPGG SLRLSCAASGFTFSSY DMHWVRQATGKGLEWV STIGTAGDTYYPGSVK GRFTISRENAENSLYL QMNSLRAGDTALYYCA RGDYYYYGMDVWGQGT TVTVSS | EIVLTQSPGTL SLSPGERATLS CRASQSVSSTY LAWYQQKPGQA PRLLIYGASNR ATGIPDRFSGS GSGTDFTLTIS RLEPEDFAVYY CQQFGTSPFTF GPGTKVDIK | EVQLVESGGGLVQP GGSLRLSCAASGFT FSSYDMHWVRQATG KGLEWVSTIGTAGD TYYPGSVKGRFTIS RENAENSLYLQMNS LRAGDTALYYCARG DYYYYGMDVWGQGT TVTVSSASTKGPSV FPLAPSSKSTSGGT AALGCLVKDYFPEP VTVSWNSGALTSGV HTFPAVLQSSGLYS | EIVLTQSPGTLSL SPGERATLSCRAS QSVSSTYLAWYQQ KPGQAPRLLIYGA SNRATGIPDRFSG SGSGTDFTLTISR LEPEDFAVYYCQQ FGTSPFTFGPGTK VDIKRTVAAPSVF IFPPSDEQLKSGT ASVVCLLNNFYPR EAKVQWKVDNALQ SGNSQESVTEQDS |

TABLE 11-continued

VH and VL Amino Acid Sequences of CD4 Antibodies

| # | Protein Name | HC Isotype | LC Isotype | VHAA sequence | VLAA sequence | Heavy Chain AA sequence | Light Chain AA sequence |
|---|---|---|---|---|---|---|---|
| | | | | | | LSSVVTVPSSLGT QTYICNVNHKPSNT KVDKKVEPKSCDKT HTCPPCPAPEAAGG PSVFLFPPKPKDTL MISRTPEVTCVVVS VSHEDPEVKFNWYV DGVEVHNAKTKPRE EQYNSTYRVVSVLT VLHQDWLNGKEYKC KVSNKALPAPIEKT ISKAKGQPREPQVY TLPPSRDELTKNQV SLTCLVKGFYPSDI AVEWESNGQPENNY KTTPPVLDSDGSFF LYSKLTVDKSRWQQ GNVFSCSVMHEALH NHYTQKSLSLSPGK SFNRGEC | KDSTYSLSSTLTL SKADYEKHKVYAC EVTHQGLSSPVTK |
| | | | | 4179 | 4180 | 4181 | 4182 |
| 60 | 75110_08M20A | IgG1 | Kappa | QVQLQESDPGLVKPSE TLSLTCTVSGGSISSY YWSWIRQPAGKGLEWI GRIYASGSTNYNPSLK SRVTMSVDTSKNQFSL KLSSVTAADTAVYYCA RDREGYYYYGMDVWGQ GTTVTVSS | DIQMTQSPSSL SASVGDRVTIT CQASQDISKYL NWYQQKPGKAP NLLIYAASNLE TGVPSRFSGSG SGTDFTFTISS LQPEDIAAYYC QQYDSLPITFG QGTRLEIK | QVQLQESDPGLVKP SETLSLTCTVSGGS ISSYYWSWIRQPAG KGLEWIGRIYASGS TNYNPSLKSRVTMS VDTSKNQFSLKLSS VTAADTAVYYCARD REGYYYYGMDVWGQ GTTVTVSSASTKGP SVFPLAPSSKSTSG GTAALGCLVKDYFP EPVTVSWNSGALTS GVHTFPAVLQSSGL YSLSSVVTVPSSSL GTQTYICNVNHKPS NTKVDKKVEPKSCD KTHTCPPCPAPEAA GGPSVFLFPPKPKD TLMISRTPEVTCVV VSVSHEDPEVKFNW YVDGVEVHNAKTKP REEQYNSTYRVVSV LTVLHQDWLNGKEY KCKVSNKALPAPIE KTISKAKGQPREPQ VYTLPPSRDELTKN QVSLTCLVKGFYPS DIAVEWESNGQPEN NYKTTPPVLDSDGS FFLYSKLTVDKSRW QQGNVFSCSVMHEA LHNHYTQKSLSLSP GK | DIQMTQSPSSLSA SVGDRVTITCQAS QDISKYLNWYQQK PGKAPNLLIYAAS NLETGVPSRFSGS GSGTDFTFTISSL QPEDIAAYYCQQY DSLPITFGQGTRL EIKRTVAAPSVFI FPPSDEQLKSGTA SVVCLLNNFYPRE AKVQWKVDNALQS GNSQESVTEQDSK DSTYSLSSTLTLS KADYEKHKVYACE VTHQGLSSPVTKS FNRGEC |
| | | | | 4213 | 4214 | 4215 | 4216 |
| 61 | 75110_09G15A | IgG1 | Kappa | EVQLVESGGGLVQPGG SLRLSCAASGFTFSDY WMSWVRQAPGKGLEWV ANINQDGSEKYSVDSV KGRFTISRDNAKNSLY LQMNSLRAEDTAIFYC AREGGQWLALDYWGQG TLVTVSS | DIQMTQSPSSV SASVGDRVTIT CRASQGISSWL AWYQQKPGKAP KLLIYGASSLQ SGVPSRFSGSG SGTDFTLTINS LQPEDFTTYYC QQANIFPWTFG QGTKVEIK | N/A | N/A |
| | | | | 4247 | 4248 | 4249 | 4250 |
| 62 | 75110_09N20A | IgG1 | Kappa | EVQLVESGGGLVQPGG SLRLSCAASGFTFSSY WMSWVRQAPGKGLEWV ANINEDGSEKYYVDSV KGRFTISRDNAKNSLY | DIQMTQSPSSV SASVGDRVTIT CRASQGISSWL AWYQQKPGKAP KLLIYAASSLQ | EVQLVESGGGLVQP GGSLRLSCAASGFT FSSYWMSWVRQAPG KGLEWVANINEDGS EKYYVDSVKGRFTI | DIQMTQSPSSVSA SVGDRVTITCRAS QGISSWLAWYQQK PGKAPKLLIYAAS SLQSGVPSSFSGS |

TABLE 11-continued

VH and VL Amino Acid Sequences of CD4 Antibodies

| # | Protein Name | HC Isotype | LC Isotype | VHAA sequence | VLAA sequence | Heavy Chain AA sequence | Light Chain AA sequence |
|---|---|---|---|---|---|---|---|
| | | | | LQMNSLRAEDTAVYYC VREGGQWLALDYWGQG TLVTVSS | SGVPSSFSGSG SGTDFTLTINS LQPEDFATYYC QQANSFPWTFG QGTKVAIK | SRDNAKNSLYLQMN SLRAEDTAVYYCVR EGGQWLALDYWGQG TLVTVSSASTKGPS VFPLAPSSKSTSGG TAALGCLVKDYFPE PVTVSWNSGALTSG VHTFPAVLQSSGLY SLSSVVTVPSSSLG TQTYICNVNHKPSN TKVDKKVEPKSCDK THTCPPCPAPEAAG GPSVFLFPPKPKDT LMISRTPEVTCVVV SVSHEDPEVKFNWY VDGVEVHNAKTKPR EEQYNSTYRVVSVL TVLHQDWLNGKEYK CKVSNKALPAPIEK TISKAKGQPREPQV YTLPPSRDELTKNQ VSLTCLVKGFYPSD IAVEWESNGQPENN YKTTPPVLDSDGSF FLYSKLTVDKSRWQ QGNVFSCSVMHEAL HNHYTQKSLSLSPG K | GSGTDFTLTINSL QPEDFATYYCQQA NSFPWTFGQGTKV AIKRTVAAPSVFI FPPSDEQLKSGTA SVVCLLNNFYPRE AKVQWKVDNALQS GNSQESVTEQDSK DSTYSLSSTLTLS KADYEKHKVYACE VTHQGLSSPVTKS FNRGEC |
| | | | | 4281 | 4282 | 4283 | 4284 |
| 63 | 75110_10K21A | IgG1 | Kappa | EVQLVESGGGLVQPGG SLRLSCAASGFTFSSY WMTWVRQAPGKGLEWV ANIKQDGSEKYYVDSV KGRFTISRDNAKNSLY LQMNSLRAEDTAVYYC VRDRYDALDIWGQGTM VTVSS | AIQMTQSPSSL SASVGDRVTIT CRASQGIRNDL NWYQQKPGKAP KLLIYAASSLQ SGVPSRFSGS SGTDFTLTISS LQAEDFATYYC LKDYNYPYTFG QGTKLEIK | EVQLVESGGGLVQP GGSLRLSCAASGFT FSSYWMTWVRQAPG KGLEWVANIKQDGS EKYYVDSVKGRFTI SRDNAKNSLYLQMN SLRAEDTAVYYCVR DRYDALDIWGQGTM VTVSSASTKGPSVF PLAPSSKSTSGGTA ALGCLVKDYFPEPV TVSWNSGALTSGVH TFPAVLQSSGLYSL SSVVTVPSSSLGTQ TYICNVNHKPSNTK VDKKVEPKSCDKTH TCPPCPAPEAAGGP SVFLFPPKPKDTLM ISRTPEVTCVVVSV SHEDPEVKFNWYVD GVEVHNAKTKPREE QYNSTYRVVSVLTV LHQDWLNGKEYKCK VSNKALPAPIEKTI SKAKGQPREPQVYT LPPSRDELTKNQVS LTCLVKGFYPSDIA VEWESNGQPENNYK TTPPVLDSDGSFFL YSKLTVDKSRWQQG NVFSCSVMHEALHN HYTQKSLSLSPGK | AIQMTQSPSSLSA SVGDRVTITCRAS QGIRNDLNWYQQK PGKAPKLLIYAAS SLQSGVPSRFSGS GSGTDFTLTISSL QAEDFATYYCLKD YNYPYTFGQGTKL EIKRTVAAPSVFI FPPSDEQLKSGTA SVVCLLNNFYPRE AKVQWKVDNALQS GNSQESVTEQDSK DSTYSLSSTLTLS KADYEKHKVYACE VTHQGLSSPVTKS FNRGEC |
| | | | | 4315 | 4316 | 4317 | 4318 |
| 64 | 75110_10L22A | IgG1 | Kappa | EVQLVESGGGLVQPGG SLRLSCAASGFTFSSY DMHWVRQATGKGLEWV STIGTAGDTYYPGSVK GRFTISRENAKNSLYL QMNGLRAGDTAVYYCA RGNYFYYGVDVWGQGT TVTVSS | EIVLTQSPGTL SLSPGERATLS CRASQSVSSSY LAWYQQKPGQA PRLLIYGASSR ATGIPDRFSGS GSGTDFTLTIS RLEPEDFAVYY | N/A | N/A |

TABLE 11-continued

VH and VL Amino Acid Sequences of CD4 Antibodies

| # | Protein Name | HC Isotype | LC Isotype | VHAA sequence | VLAA sequence | Heavy Chain AA sequence | Light Chain AA sequence |
|---|---|---|---|---|---|---|---|
| | | | | | CQQYGISPFTF GPGTKVDIK | | |
| | | | | 4349 | 4350 | 4351 | 4352 |
| 65 | 75110_10N21A | IgG1 | Kappa | EVQLVESGGGLVQPGG SLRLSCAASGFTFSSY DMHWVRQVTGKGLEWV STIGTAGDTYYPGSVK GRFTISRENAKNSLYL QMNSLRAGDTAVYYCA RGGYYYYGMDVWGQGT TVTVSS | EIVLTQSPGTL SLSPGERATLS CRASQSFISSY LAWYQQKPGQA PRLLIYGASSR ATGIPDRFSGS GSGTDFTLTIS RLDPEDFAVYY CQQSGNSPFTF GPGTKVDVK | N/A | N/A |
| | | | | 4383 | 4384 | 4385 | 4386 |
| 66 | 75110_10O16A | IgG1 | Kappa | EVQLVESGGGLVQPGG SLRLSCAASGFTFSNS DMHWVRQATGKGLEWV STIGTAGDTYYPGSVK GRFTISRENAKNSLYL QMNSLRAGDTAVYYCA RGGLYYYGMDVWGQGT TVTVSS | ENVLTQSPGTL SLSPGERATLS CRASQSVSSSY LAWYQQKPGQA PRLLIYGASSR ATGIPDRFSGS GSGTDFTLTIS RLEPEDFAVYY CHQFGSSPFTF GPGTKVDIK | N/A | N/A |
| | | | | 4417 | 4418 | 4419 | 4420 |
| 67 | 75110_11D03A | IgG1 | Kappa | EVQLVESGGGLVQPGG SLRLSCAASGFTFSSY WMSWVRQAPGKGLEWV ANINQDGNEKYYVDSV KGRFTISRDNAKNSLF LQMNSLRAEDTAVYYC AREGGQWLALDYWGQG ALVTVSS | DIQMTQSPSSV SASVGDRVTIT CRASQGISSWL AWYQQKPGKAP KFLISGASSLQ SGVPSRFSGSG SGTDFTLTISS LQPEDFATYYC QQANSFPWTFG QGTKVEIK | N/A | N/A |
| | | | | 4451 | 4452 | 4453 | 4454 |
| 68 | 75110_12C19A | IgG1 | Kappa | EVQLVESGGGLVQPGG SLRLSCAASGFTFSSY WMSWVRQAPGKGLEWV ANIKEDGSDKYYVDSV KGRFTISRDNAKNSLY LQMNSLRAEDTAVHYC VREGGQWLALDYWGQG TLVTVSS | DIQMTQSPSSV SGSVGDRVTIT CRASQGISSWL AWYQQKPGKAP KLLIYGASSLQ SGVPSRFSGSG SGTDFTLTISS LQPEDFVTYYC QQANSFPWTFG QGTKVEIK | N/A | N/A |
| | | | | 4485 | 4486 | 4487 | 4488 |
| 69 | 75110_12H17A | IgG1 | Kappa | EVQLVESGGGLVQPGG SLRLSCAASGFTFSDY WMSWVRQAPGKGLEWV ANIKEDGNEKYYVDSV KGRFTISRDNAKNSLF LQMNSLRAEDTAVYYC AREGGQWLALDYWGQG ALVTVSS | DIQMTQSPSSV SASVGDRVTIT CRASQGISSWL AWYQQKPGKAP KFLISGASSLQ SGVPSRFSGSG SGTDFTLTISS LQPEDFATYYC QQANSFPWTFG QGTKVEIK | N/A | N/A |
| | | | | 4519 | 4520 | 4521 | 4522 |
| 70 | 75110_12H19A | IgG1 | Kappa | EVQLVESGGGLVQPGG SLRLSCAASGFTFSSY WMSWVRQAPGQGLEWV ANINEDGNEKYHVDSV KGRLTISRDNAKNSLY LQMNSLRGVDTAVYFC AREGGQWLALDYWGQG ALVTVSS | DIQMTQSPSSV SASVGDRVSIT CRASQGISSWL AWYQQKPGKAP KLLIYGASGLQ SGVPSRFSGSG SGTDFTLTISS LQPEDFATYYC | N/A | N/A |

TABLE 11-continued

VH and VL Amino Acid Sequences of CD4 Antibodies

| # | Protein Name | HC Isotype | LC Isotype | VHAA sequence | VLAA sequence | Heavy Chain AA sequence | Light Chain AA sequence |
|---|---|---|---|---|---|---|---|
| | | | | | QQANSFPWTFG QGTKVEIK | | |
| | | | | | 4553 | 4554 | 4555 | 4556 |
| 71 | 75110_12K21A | IgG1 | Kappa | QVQLQQWGAGLLKPSE TLSLTCAVSGGSFSGY YWSWIRQPPGKGLEWI GEINHSGSTNCNPSLK SRVTISVDTSNNQFSL KLSSVTAADTAVYYCA RVLNYFDYWGQGTLVT VSS | DIQMTQSPSSV SASVGDRVTIT CRASPDIANWL AWYQQKPGKAP ELLIYAASSLQ SGVPSRFSGSG SGTDFTLTISS LQPEDFATYFC QQANSFPLTFG GGTKVESK | QVQLQQWGAGLLKP SETLSLTCAVSGGS FSGYYWSWIRQPPG KGLEWIGEINHSGS TNCNPSLKSRVTIS VDTSNNQFSLKLSS VTAADTAVYYCARV LNYFDYWGQGTLVT VSSASTKGPSVFPL APSSKSTSGGTAAL GCLVKDYFPEPVTV SWNSGALTSGVHTF PAVLQSSGLYSLSS VVTVPSSSLGTQTY ICNVNHKPSNTKVD KKVEPKSCDKTHTC PPCPAPEAAGGPSV FLFPPKPKDTLMIS RTPEVTCVVVSVSH EDPEVKFNWYVDGV EVHNAKTKPREEQY NSTYRVVSVLTVLH QDWLNGKEYKCKVS NKALPAPIEKTISK AKGQPREPQVYTLP PSRDELTKNQVSLT CLVKGFYPSDIAVE WESNGQPENNYKTT PPVLDSDGSFFLYS KLTVDKSRWQQGNV FSCSVMHEALHNHY TQKSLSLSPGK | DIQMTQSPSSVSA SVGDRVTITCRAS PDIANWLAWYQQK PGKAPELLIYAAS SLQSGVPSRFSGS GSGTDFTLTISSL QPEDFATYFCQQA NSFPLTFGGGTKV ESKRTVAAPSVFI FPPSDEQLKSGTA SVVCLLNNFYPRE AKVQWKVDNALQS GNSQESVTEQDSK DSTYSLSSTLTLS KADYEKHKVYACE VTHQGLSSPVTKS FNRGEC |
| | | | | 4587 | 4588 | 4589 | 4590 |
| 72 | 75110_13C07A | IgG1 | Kappa | EVQLVESGGVLVQPGG SLRLSCAASGFTFSNY DMHWVRQATGKGLEWV STIGTAGDTYYPGSVK GRFTLSRENAKNSLYL QMHSLRAGDTAVYYCA RGAYGYYGMDVWGQGT TVTVSS | EIVLTQSPGTL SLSPGERATLS CRASQSVSSSY LAWYQQKPGQA PRLLIYGASSR ATGIPDRFSGS GSGTDFILTIS RLEPEDFAVYY CQQYGFSPFTF GPGTKVDIK | N/A | N/A |
| | | | | 4621 | 4622 | 4623 | 4624 |
| 73 | 75110_13C13A | IgG1 | Kappa | QVQLQQWGAGLLKPSE TLSLTCAVSGGSFSGY YWSWIRQPPGKGLEWI GEINHSGSTNCNPSLK SRVTISVDTSKNQFSL KLSSVTAADTAMYYCA RVLNFFDYWGQGTLVT VSS | DIQMTQTPSSV SASVGDRVTIT CRASPGISNWL AWYQQKPGKAP ELLIYAASSLQ SGVPSRFSGSG SGTDFTLTISS LQPEDFATYFC QQANSFPLTFG GGTKVESK | N/A | N/A |
| | | | | 4655 | 4656 | 4657 | 4658 |
| 74 | 75110_13P21A | IgG1 | Kappa | QVQLQQWGAGLLKPSE TLSLTCAVSGGSFSGY YWSWIRQPPGKGLEWI GEINHSGSTNCNPSLK SRVTISVDTSNNQFSL KLSSVTAADTAVYYCA RVLNYFDYWGQGTLVT VSS | DIQMTQSPSSV SASVGDRVTIT CRASPDIANWL AWYQQKPGKAP ELLIYAASSLQ SGVPSRFSGSG SGTDFTLTISS LQPEDFATYFC QQANSFPLTFG GGTKVESK | N/A | N/A |
| | | | | 4689 | 4690 | 4691 | 4692 |

TABLE 11-continued

VH and VL Amino Acid Sequences of CD4 Antibodies

| # | Protein Name | HC Isotype | LC Isotype | VHAA sequence | VLAA sequence | Heavy Chain AA sequence | Light Chain AA sequence |
|---|---|---|---|---|---|---|---|
| 75 | 75110_13P22A | IgG1 | Kappa | QVQLQQWGAGLLKPSE TLSLTCAAYGGSFSGY YWSWIRQSPGKGLEWI GEINQSGNTNYNPSLK SRVTISADTSKNQFSL KLSSVTAADTAVYYCA RVLNWFDYWGQGILVT VSS <br><br> 4723 | DIQMTQSPSSV SASVGDRVTIT CRASQGISDWL AWYQQKSGKAP DLLIFAASSLQ SGVPSRFSGSG SGTDFTLTISS LQPEDFATYYC QQANSFPYTFG QGTKLEIK <br><br> 4724 | N/A <br><br><br><br><br><br><br><br><br> 4725 | N/A <br><br><br><br><br><br><br><br><br> 4726 |
| 76 | 75110_14G10A | IgG1 | Kappa | EVQLVESGGGLVKPGG SLRLSCAASGFTFSSY SMNWVRQAPGKGLEWV SFISSSSSYIYYADSV KGRFTISRDNAKNSLY LQMNSLRAEDTAVYYC ARERGDDYGDYEGAFD IWGQGTMVTVSS <br><br> 4757 | DIQMTQSPSSL SASVGDRVTIT CQASQDISNYL NWYQQKPGKAP KLLIYDASNLE TGVPSRFSGSG SGTDFTFTISS LQPEDIATYYC QQYDNLPYTFG QGTKLEIK <br><br> 4758 | N/A <br><br><br><br><br><br><br><br><br> 4759 | N/A <br><br><br><br><br><br><br><br><br> 4760 |
| 77 | 75110_14H13A | IgG1 | Kappa | EVQLVESGGGLVQPGG SLRLSCAASGFTFSNY DMHWVRQATGKGLEWV STIGTAGDTYYPGSVK GRFTISRKNAKNSLYL QMISLRAGDTAVYYCA RGGDYYYGMDVWGQGT TVTVSS <br><br> 4791 | EIVLTQSPGTL SLSPGERATLS CRASQSVSSSY LAWYQQKPGQA PRLLIYGASSR ATGIPDRFSGS GSGTDFTLTIS RLEPEDFAVYY CQQFGSSPFTF GPGTKVDIK <br><br> 4792 | N/A <br><br><br><br><br><br><br><br><br> 4793 | N/A <br><br><br><br><br><br><br><br><br> 4794 |
| 78 | 75110_14I16A | IgG1 | Kappa | QVQLQESGPGLVKPSE TLSLTCTVSNGSISSY YWSWIRQSAGKGLEWI GRIYTSGSTNYNPSLK SRVTMLVDTSKNQFSL KLSSVTAADTAVYYCA RDREDYYYYGMDVWGQ GTTVTVSS <br><br> 4825 | DIQMTQSPSSL SASVGDRVTIT CQASHDISNYL NWYQQKPGKAP KLLLYYASNLE TGVPSRFSGSG SGTDFTFTITS LQPEDIGTYSC QQYDNLPLTFG GGTKVEIK <br><br> 4826 | N/A <br><br><br><br><br><br><br><br><br> 4827 | N/A <br><br><br><br><br><br><br><br><br> 4828 |
| 79 | 75110_14N19A | IgG1 | Kappa | QVQLQESGPGLVKPSE TLSLTCTVSGGSISRY YWSWIRQPAGKGLEWI GRICTSENPNYNPALK SRVTMSVDTSKNQFSL KLSSVTAADTAVYYCA RELERLNYYGMDVWGQ GTTVTVSS <br><br> 4859 | DIQMTQFPSSL SASVGDRVTIT CQASQDISNYL NWYQQKPGKAP KLLIYDASNLE SGVPSRFSGRG SGTDFTFTISS LQPEDFATFYC QQYDTLPITFG QGTRLEIK <br><br> 4860 | N/A <br><br><br><br><br><br><br><br><br> 4861 | N/A <br><br><br><br><br><br><br><br><br> 4862 |
| 80 | 75110_14P05A | IgG1 | Kappa | EVQLVESGGGLVQPGG SLRLSCAASGFTFSSY DVHWVRQATGKGLEWV STIGTAGDTYYPGSVK GRFTISRENAKNSLYL QMNSLRAGDTAVYYCA RGGFYYYGMDVWGQGT TVTVSS <br><br> 4893 | EIVLTQSPGTL SLSPGERATLS CRASQSVSSSY LAWYQQKPGQT PRLLIYGASSR ATGIPDRFSGS GSGTDFTLTIS RLEPEDFAVFY CQQSGSSPFTF GPGTKVDVK <br><br> 4894 | N/A <br><br><br><br><br><br><br><br><br> 4895 | N/A <br><br><br><br><br><br><br><br><br> 4896 |

TABLE 11-continued

VH and VL Amino Acid Sequences of CD4 Antibodies

| # | Protein Name | HC Isotype | LC Isotype | VHAA sequence | VLAA sequence | Heavy Chain AA sequence | Light Chain AA sequence |
|---|---|---|---|---|---|---|---|
| 81 | 75110_14P08A | IgG1 | Kappa | QVQLQESGPGLVKSSETLSLTCTDSGDSIRSYYWNWIRQPAGKGLEWIGRIYASGSTNYNPSLKSRVIMSADTSKNRFSLKLSSVTAADTAVYYCARDGGVGDSLDYWGQGTLVTVSS | DIVMTQTPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPFTFGPGTKVDIK | N/A | N/A |
| | | | | 4927 | 4928 | 4929 | 4930 |
| 82 | 75110_01A07A_2 | IgG1 | Kappa | QVQLQESGPGLVKPSETLSLTCTVSGGSIINYYWSWIRQPAGKGLEWIGRIYSSGSTNYKSSLKSRVTMSVDTSKNQFYLKLRSVTAADTAVYYCREREAYLYYGLDVWGQGTTVTVSS | DIQMTQSPSAMSASVGDRVTITCRASQGITNYLAWFQQKPGKVPKRLIYVTSSFQSGVPSRFSASGSGTEFNLTISGLQPEDFAIYYCLQHNNYPLTFGGGTKVEIK | N/A | N/A |
| | | | | 4961 | 4962 | 4963 | 4964 |

TABLE 12

Kabat CDR Amino Acid Sequences of CD4 Antibodies

| # | Protein Name | HC Kabat CDR1 | HC Kabat CDR2 | HC Kabat CDR3 | LC Kabat CDR1 | LC Kabat CDR2 | LC Kabat CDR3 |
|---|---|---|---|---|---|---|---|
| 1 | 75110_01A06A | SYWMS 2177 | NINEDGNEKYYVDSVKG 2178 | EGGQWLSLDY 2179 | RASQGISSWLA 2180 | GASSLQS 2181 | QQANSFPWT 2182 |
| 2 | 75110_01A07A_1 | NYYWS 2211 | RIYSSGSTNYKSSLKS 2212 | EREAYLYYGLDV 2213 | QASQDIGNYLN 2214 | DASNLET 2215 | QQYDSLPLT 2216 |
| 3 | 75110_01C18A | SNYMN 2245 | VIYAGDNTYSADSVKG 2246 | EGGTTGAFDI 2247 | RASQGINSWLA 2248 | AASSLQS 2249 | QQGNSFPYT 2250 |
| 4 | 75110_01D24A | GYYWS 2279 | EINHSGSTNYNPSLKS 2280 | LVNWFDP 2281 | RASQDISNWLA 2282 | AASSLQT 2283 | QQANSFPYS 2284 |
| 5 | 75110_01E08A | NYDMH 2313 | TIGTAGDTYYPASVKG 2314 | GGDYYYGMDV 2315 | RASQSVSSSYLA 2316 | GASSRAT 2317 | QQFGSSPFT 2318 |
| 6 | 75110_01G11A | SYDMH 2347 | TIGTAGDTYYPGSVKG 2348 | GGDYYYGMDV 2349 | RASQNTYSSYLA 2350 | GASNRAT 2351 | QQHGTSPFT 2352 |
| 7 | 75110_01H18A | GYYWS 2381 | EINQSGSTNYNPSLKS 2382 | VINWFDS 2383 | RASQGISSWLA 2384 | AASSFQS 2385 | QQANSFPYT 2386 |
| 8 | 75110_01J09A | SYWMS 2415 | NTKEDGSDKYYVDSVKG 2416 | EGGQWLALDY 2417 | RASQGISSWLA 2418 | GASSLQS 2419 | QQANSFPWT 2420 |
| 9 | 75110_01J17A | SYDMH 2449 | TIGTADDTYYPGSVKG 2450 | GGDYYYGMDV 2451 | RASQSVYISYLA 2452 | GASSRAT 2453 | QQFGSSPFT 2454 |
| 10 | 75110_01K10A | NYDMH 2483 | TIGTAGDTYYPGSVKG 2484 | GGDYYYGMDV 2485 | RASQSLSSVYLA 2486 | GASSRAT 2487 | QQYGSSPFT 2488 |
| 11 | 75110_01L08A | HYYWS 2517 | YIHYSGTTNYNPSLKS 2518 | DQGFSSGGMDV 2519 | QASQDISNYLN 2520 | DASNLET 2521 | QQYDNLPLT 2522 |
| 12 | 75110_01N04A | NYDMH 2551 | TIGTAGDTYYPGSVKG 2552 | GGDFYYGLDV 2553 | RASQSVSSVYLA 2554 | GASSRAT 2555 | QQYGSSPFT 2556 |

TABLE 12-continued

Kabat CDR Amino Acid Sequences of CD4 Antibodies

| # | Protein Name | HC Kabat CDR1 | HC Kabat CDR2 | HC Kabat CDR3 | LC Kabat CDR1 | LC Kabat CDR2 | LC Kabat CDR3 |
|---|---|---|---|---|---|---|---|
| 13 | 75110_02E08A | TYYWT 2585 | RVYTSGDTNYNPSLKS 2586 | DSGALYSWNYGDAFDI 2587 | RASQDISNYLA 2588 | AASSLQS 2589 | LQHNSYPRT 2590 |
| 14 | 75110_02E22A | SFYWS 2619 | RIYTSGSTNYNPSLKS 2620 | ELEKRNYYGMDV 2621 | QASHDISNYLN 2622 | DASTLET 2623 | QQYDSLPLT 2624 |
| 15 | 75110_02I16A | GYYWT 2653 | EINHSGTTNSNPSLKS 2654 | ELNWFDP 2655 | RASQDIANWLA 2656 | AASSLLG 2657 | QQANSFPYT 2658 |
| 16 | 75110_02I18A | SYDMH 2687 | TIGTAGDTYYPGSVKG 2688 | GGYYYYGMDV 2689 | RASQSVSSSYLA 2690 | GASSRAT 2691 | QQYGSSPFT 2692 |
| 17 | 75110_02K11A | SGFYYWT 2721 | YISYSGNTYYNPSFKS 2722 | DRPSNFDAFDI 2723 | RASQSVSTSYLA 2724 | GASSRAT 2725 | QQYGRSPLT 2726 |
| 18 | 75110_02N15A | SYWMS 2755 | NINEDGNEKYYVDSVKG 2756 | EGGQWLALDH 2757 | RASQGISSWLA 2758 | GASSLQS 2759 | QQANSFPWT 2760 |
| 19 | 75110_03B16A | SYWMS 2789 | NINEDGSEKNYVDSVKG 2790 | EGGQWLALDY 2791 | RASQGIRSWLA 2792 | GASSLQS 2793 | QQANSFPWT 2794 |
| 20 | 75110_03C01A | GYYWS 2823 | EINQSGSTNYNPSLKS 2824 | VINWFDS 2825 | RASQGISSWLA 2826 | DASSFQS 2827 | QQANSFPYT 2828 |
| 21 | 75110_03D16A | SYWMS 2857 | NINQDGGEKYYVDSVKG 2858 | EGGQWLALDY 2859 | RASQGISSWLT 2860 | AASSLQS 2861 | QQANSFPWT 2862 |
| 22 | 75110_03I08A | SYYWS 2891 | YIYYSGSTNYNPSLKS 2892 | EGEQWFYGLDV 2893 | RASQSVSSTYLA 2894 | GSSSRAT 2895 | QQYGNSFPIT 2896 |
| 23 | 75110_03I23A | SYYWN 2925 | RIYTSGSTNYNPSLKS 2926 | DPGYSDAFNI 2927 | QASQDISNYLN 2928 | DASNLET 2929 | QQCDNLPLT 2930 |
| 24 | 75110_03L12A | GYYWS 2959 | EINHSGSTNYNPSLKS 2960 | LINWFDP 2961 | RASQDISNWLA 2962 | AASSLQS 2963 | QQANSFPYT 2964 |
| 25 | 75110_04B08A | NYGIH 2993 | IIWYDGSKKYYADSVKG 2994 | EDDWNDGLAY 2995 | RASQDIRNDLG 2996 | AASNLQS 2997 | LQDSNYPRT 2998 |
| 26 | 75110_04D20A | DYYWS 3027 | RIYTSGSTNYNPSLKS 3028 | ELERYYFYGVDV 3029 | QASQDISNYLN 3030 | AASNLET 3031 | QQYDSLPLT 3032 |
| 27 | 75110_04F22A | SYDIH 3061 | TIGTAGDTYYPGSVKG 3062 | GGYYYYGMDV 3063 | RASQSVYSSYLA 3064 | GASSRAT 3065 | QQFGTSPFT 3066 |
| 28 | 75110_04G02A | NAWMS 3095 | RIKSKTDGGTTDYAAPVKG 3096 | GGWFGELWGPFDI 3097 | KSSQSVLYSSNNKNYLA 3098 | WASARES 3099 | QQYFGSFPT 3100 |
| 29 | 75110_04G16A | SGYYYWS 3129 | YISYSGSTYYNPSLKS 3130 | DRPSNFDAFDI 3131 | RASQSVGSTYLA 3132 | GAFSRAT 3133 | QQYGSSPLT 3134 |
| 30 | 75110_04H17A | TYYWS 3163 | RIYTSERPNYNPSLKS 3164 | ELERPYYYGMDV 3165 | QASQDISNYLN 3166 | YASNLET 3167 | QQYDNLPLT 3168 |
| 31 | 75110_04K10A | SYWMS 3197 | NINQDGSEKYYVDSVKG 3198 | EGGQWLSLDY 3199 | RASQGISSWLA 3200 | GVSSFQS 3201 | QQANSFPWT 3202 |
| 32 | 75110_04P06A | NYDMH 3231 | TIGTAGDTYYPGSVKG 3232 | GGDYYYGMDV 3233 | RASQSLSSVYLA 3234 | GASSRAT 3235 | QQYGSSPFT 3236 |
| 33 | 75110_04P08A | GYYWS 3265 | EINQSGSTNYNPSLKS 3266 | VLNWFDP 3267 | RASQDISNWLA 3268 | AASSLQS 3269 | QQANSFPYT 3270 |
| 34 | 75110_05A11A | NTWMS 3299 | RIKSKIDGGTTDYAAPVKG 3300 | SGTYSSGWGLFDY 3301 | QASQDISNYLN 3302 | DTSNLEA 3303 | QQYDNLPFT 3304 |
| 35 | 75110_05B13A | GYYWT 3333 | EINHRGSTNYNPSLKS 3334 | PDSNWFDP 3335 | RASQDISNWLA 3336 | AASSLQS 3337 | QQANSFPLT 3338 |

TABLE 12-continued

Kabat CDR Amino Acid Sequences of CD4 Antibodies

| # | Protein Name | HC Kabat CDR1 | HC Kabat CDR2 | HC Kabat CDR3 | LC Kabat CDR1 | LC Kabat CDR2 | LC Kabat CDR3 |
|---|---|---|---|---|---|---|---|
| 36 | 75110_05E05A | SYYWS 3367 | RIYTSGSTNYNPSLKS 3368 | DGGVGDSLDY 3369 | RSSQSLLDSDDGNTYLD 3370 | TLSYRAS 3371 | MQHIEFPFT 3372 |
| 37 | 75110_05E13A | NAWMS 3401 | RVESKTDGGTTDYAAPVKD 3402 | GGGFGLELYGFFDY 3403 | RASQSISSWLA 3404 | KASSLES 3405 | LQYNSYYT 3406 |
| 38 | 75110_05F19A | NYDVH 3435 | TIGTAGDTYYPGSVKG 3436 | GGYDYYGLDV 3437 | RASQSVSSTYLA 3438 | GASSRAT 3439 | QQYGSSPFT 3440 |
| 39 | 75110_05G15A | SGGYFWS 3469 | CIYYSGSTYYIPSLKS 3470 | DGYDYWYFDL 3471 | RASQSVSSSYLA 3472 | GASSRAT 3473 | QQYGSSPYT 3474 |
| 40 | 75110_05K11A | SYDMH 3503 | TIGTAGDTYYPASVKG 3504 | GGFYYYGMDV 3505 | RASQSVSNTYLA 3506 | GASSRAT 3507 | QQHGSSPFT 3508 |
| 41 | 75110_05L07A | SYWMS 3537 | NINQDGSDKYYVDSVKG 3538 | EGGQWLTLDY 3539 | RASQSVSSTYLA 3540 | GASSRAT 3541 | QQYGSSPFT 3542 |
| 42 | 75110_06C16A | DYYWS 3571 | RIYSSGSTNYNPSLKS 3572 | DREDYYYYGMDV 3573 | QASHDISNYLN 3574 | AASNLET 3575 | QQYDHLPLT 3576 |
| 43 | 75110_06D16A | GYYWS 3605 | EINHSGSTNYNPSLKS 3606 | VLNWFDP 3607 | RASQDIADWLA 3608 | AASSFQS 3609 | QQANSFPYT 3610 |
| 44 | 75110_06E14A | NYFWS 3639 | RIYSSGNTNYNPSLKS 3640 | DREDYYYYGMDV 3641 | QASQDISNYLN 3642 | GASILET 3643 | QQYDSLPIT 3644 |
| 45 | 75110_06G04A | SYYWS 3673 | RIYISGSTNYNPSLKS 3674 | ELERPYYYGMDV 3675 | QASQDISNYLN 3676 | NASTLET 3677 | QQYDNLPLT 3678 |
| 46 | 75110_06K03A | TYYWS 3707 | RINTSGSTTYNPSLKS 3708 | ELERYYYYGMDV 3709 | QASQDISNYLN 3710 | YASILET 3711 | QQYDSLPLT 3712 |
| 47 | 75110_07B16A | GYYWS 3741 | EINQSGSTNYNPSLKS 3742 | VINWFDS 3743 | RASQGISSWLA 3744 | DASSFQS 3745 | QQANSFPYT 3746 |
| 48 | 75110_07E04A | SYDMH 3775 | TIGTAGDTYYPGSVKG 3776 | GGYYYYGMDV 3777 | RASQSISSTYLA 3778 | GASSRAT 3779 | QQYGSSPFT 3780 |
| 49 | 75110_07H07A | SYWMS 3809 | NIKEEGSEKYYVDSVKG 3810 | EGGQWLALDY 3811 | RASQGISSWLA 3812 | GASSLQS 3813 | QQANSFPWT 3814 |
| 50 | 75110_07102A | SYWMS 3843 | NIKEDGSEKYYVDSVKG 3844 | DGSYSGYGMDV 3845 | RASQGIRNDLG 3846 | AASSLQS 3847 | LLDYNYPYT 3848 |
| 51 | 75110_07124A | SYYYN 3877 | RIYTSGRTDYNPSLKS 3878 | DEGPTDAFDI 3879 | RSSQSLLDSDDGNTYLD 3880 | TLSYRAS 3881 | MQRIEFPFT 3882 |
| 52 | 75110_07N04A | SFYWS 3911 | RIYTSGSTNYNPSLKS 3912 | DPGYSDAFAI 3913 | QASQDISNYLT 3914 | DTSNLET 3915 | QQYDNLPLT 3916 |
| 53 | 75110_08A13A | SYWMS 3945 | NIKQDGSEKYYMDSVKG 3946 | DNSYYYYGMDV 3947 | RASQGIRDDLG 3948 | AASSLQS 3949 | LHHYNYPYT 3950 |
| 54 | 75110_08D24A | GFYWS 3979 | RIYTSENTNYNPSLKS 3980 | DREGYYYYGMDV 3981 | QASQDISNYLN 3982 | AASNLET 3983 | QQYDSLPIT 3984 |
| 55 | 75110_08F20A | TYYWS 4013 | RICTTENTNYNPSLKS 4014 | DLERLNYYGMDV 4015 | QASQDISKYLN 4016 | DASNLET 4017 | QQYDSLPIT 4018 |
| 56 | 75110_08G08A | TYYWS 4047 | RICTTENTNYNPSLKS 4048 | DLERLNYYGMDV 4049 | QASQDISNYLN 4050 | DASNLET 4051 | QQYDSLPIT 4052 |
| 57 | 75110_08H06A | NYDMH 4081 | TIGTAGDTYYPGSVKG 4082 | GGYDYYGMDV 4083 | RASQSITSIYLA 4084 | GASSRAT 4085 | QQYGSSPFT 4086 |
| 58 | 75110_08H11A | SYDMH 4115 | TIGTAGDTYYPGSVKG 4116 | GGYSYYGMDV 4117 | GASQSVSSTYLA 4118 | GASSRAT 4119 | QQFGSSPFT 4120 |

TABLE 12-continued

Kabat CDR Amino Acid Sequences of CD4 Antibodies

| # | Protein Name | HC Kabat CDR1 | HC Kabat CDR2 | HC Kabat CDR3 | LC Kabat CDR1 | LC Kabat CDR2 | LC Kabat CDR3 |
|---|---|---|---|---|---|---|---|
| 59 | 75110_08K12A | SYDMH 4149 | TIGTAGDTYYPGSVKG 4150 | GDYYYYGMDV 4151 | RASQSVSSTYLA 4152 | GASNRAT 4153 | QQFGTSPFT 4154 |
| 60 | 75110_08M20A | SYYWS 4183 | RIYASGSTNYNPSLKS 4184 | DREGYYYYGMDV 4185 | QASQDISKYLN 4186 | AASNLET 4187 | QQYDSLPIT 4188 |
| 61 | 75110_09G15A | DYWMS 4217 | NINQDGSEKYSVDSVKG 4218 | EGGQWLALDY 4219 | RASQGISSWLA 4220 | GASSLQS 4221 | QQANIFPWT 4222 |
| 62 | 75110_09N20A | SYWMS 4251 | NINEDGSEKYYVDSVKG 4252 | EGGQWLALDY 4253 | RASQGISSWLA 4254 | AASSLQS 4255 | QQANSFPWT 4256 |
| 63 | 75110_10K21A | SYWMT 4285 | NIKQDGSEKYYVDSVKG 4286 | DRYDALDI 4287 | RASQGIRNDLN 4288 | AASSLQS 4289 | LKDYNYPYT 4290 |
| 64 | 75110_10L22A | SYDMH 4319 | TIGTAGDTYYPGSVKG 4320 | GNYFYYGVDV 4321 | RASQSVSSSYLA 4322 | GASSRAT 4323 | QQYGISPET 4324 |
| 65 | 75110_10N21A | SYDMH 4353 | TIGTAGDTYYPGSVKG 4354 | GGYYYYGMDV 4355 | RASQSFISSYLA 4356 | GASSRAT 4357 | QQSGNSPFT 4358 |
| 66 | 75110_10O16A | NSDMH 4387 | TIGTAGDTYYPGSVKG 4388 | GGLYYYGMDV 4389 | RASQSVSSSYLA 4390 | GASSRAT 4391 | HQFGSSPFT 4392 |
| 67 | 75110_11D03A | SYWMS 4421 | NINQDGNEKYYVDSVKG 4422 | EGGQWLALDY 4423 | RASQGISSWLA 4424 | GASSLQS 4425 | QQANSFPWT 4426 |
| 68 | 75110_12C19A | SYWMS 4455 | NIKEDGSDKYYVDSVKG 4456 | EGGQWLALDY 4457 | RASQGISSWLA 4458 | GASSLQS 4459 | QQANSFPWT 4460 |
| 69 | 75110_12H17A | DYWMS 4489 | NIKEDGNEKYYVDSVKG 4490 | EGGQWLALDY 4491 | RASQGISSWLA 4492 | GASSLQS 4493 | QQANSFPWT 4494 |
| 70 | 75110_12H19A | SYWMS 4523 | NINEDGNEKYHVDSVKG 4524 | EGGQWLALDY 4525 | RASQGISSWLA 4526 | GASGLQS 4527 | QQANSFPWT 4528 |
| 71 | 75110_12K21A | GYYWS 4557 | EINHSGSTNCNPSLKS 4558 | VLNYFDY 4559 | RASPDIANWLA 4560 | AASSLQS 4561 | QQANSFPLT 4562 |
| 72 | 75110_13C07A | NYDMH 4591 | TIGTAGDTYYPGSVKG 4592 | GAYGYYGMDV 4593 | RASQSVSSSYLA 4594 | GASSRAT 4595 | QQYGFSPFT 4596 |
| 73 | 75110_13C13A | GYYWS 4625 | EINHSGSTNCNPSLKS 4626 | VLNFFDY 4627 | RASPGISNWLA 4628 | AASSLQS 4629 | QQANSFPLT 4630 |
| 74 | 75110_13P21A | GYYWS 4659 | EINHSGSTNCNPSLKS 4660 | VLNYFDY 4661 | RASPDIANWLA 4662 | AASSLQS 4663 | QQANSFPLT 4664 |
| 75 | 75110_13P22A | GYYWS 4693 | EINQSGNTNYNPSLKS 4694 | VLNWFDY 4695 | RASQGISDWLA 4696 | AASSLQS 4697 | QQANSFPYT 4698 |
| 76 | 75110_14G10A | SYSMN 4727 | FISSSSSYIYYADSVKG 4728 | ERGDDYGDYEGAFDI 4729 | QASQDISNYLN 4730 | DASNLET 4731 | QQYDNLPYT 4732 |
| 77 | 75110_14H13A | NYDMH 4761 | TIGTAGDTYYPGSVKG 4762 | GGDYYYGMDV 4763 | RASQSVSSSYLA 4764 | GASSRAT 4765 | QQFGSSPFT 4766 |
| 78 | 75110_14I16A | SYYWS 4795 | RIYTSGSTNYNPSLKS 4796 | DREDYYYYGMDV 4797 | QASHDISNYLN 4798 | YASNLET 4799 | QQYDNLPLT 4800 |
| 79 | 75110_14N19A | RYYWS 4829 | RICTSENPNYNPALKS 4830 | ELERLNYYGMDV 4831 | QASQDISNYLN 4832 | DASNLES 4833 | QQYDTLPIT 4834 |
| 80 | 75110_14P05A | SYDVH 4863 | TIGTAGDTYYPGSVKG 4864 | GGFYYYGMDV 4865 | RASQSVSSSYLA 4866 | GASSRAT 4867 | QQSGSSPFT 4868 |
| 81 | 75110_14P08A | SYYWN | RIYASGSTNYNPSLKS 4898 | DGGVGDSLDY 4899 | RSSQSLLDSDDGNTYLD 4900 | TLSYRAS 4901 | MQRIEFPFT 4902 |
| 82 | 75110_01A07A_2 | NYYWS 4931 | RIYSSGSTNYKSSLKS 4932 | EREAYLYYGLDV 4933 | RASQGITNYLA 4934 | VTSSFQS 4935 | LQHNNYPLT 4936 |

TABLE 13

Chothia CDR Amino Acid Sequences of CD4 Antibodies

| # | Protein Name | HC Chothia CDR1 | HC Chothia CDR2 | HC Chothia CDR3 | LC Chothia CDR1 | LC Chothia CDR2 | LC Chothia CDR3 |
|---|---|---|---|---|---|---|---|
| 1 | 75110_01A06A | GFTFSSY 2183 | NEDGNE 2184 | EGGQWLSLD 2185 | SQGISSW 2186 | GAS 2187 | ANSFPW 2188 |
| 2 | 75110_01A07A_1 | GGSIINY 2217 | YSSGS 2218 | EREAYLYYGLD 2219 | SQDIGNY 2220 | DAS 2221 | YDSLPL 2222 |
| 3 | 75110_01C18A | GFTVSSN 2251 | YAGDN 2252 | EGGTTGAFD 2253 | SQGINSW 2254 | AAS 2255 | GNSFPY 2256 |
| 4 | 75110_01D24A | GGSFSGY 2285 | NHSGS 2286 | LVNWFD 2287 | SQDISNW 2288 | AAS 2289 | ANSFPY 2290 |
| 5 | 75110_01E08A | GFTFNNY 2319 | GTAGD 2320 | GGDYYYGMD 2321 | SQSVSSSY 2322 | GAS 2323 | FGSSPF 2324 |
| 6 | 75110_01G11A | GFTFSSY 2353 | GTAGD 2354 | GGDYYYGMD 2355 | SQNTYSSY 2356 | GAS 2357 | HGTSPF 2358 |
| 7 | 75110_01H18A | GGSFSGY 2387 | NQSGS 2388 | VINWFD 2389 | SQGISSW 2390 | AAS 2391 | ANSFPY 2392 |
| 8 | 75110_01J09A | GFTFSSY 2421 | KEDGSD 2422 | EGGQWLALD 2423 | SQGISSW 2424 | GAS 2425 | ANSFPW 2426 |
| 9 | 75110_01J17A | GFTFSSY 2455 | GTADD 2456 | GGDYYYGMD 2457 | SQSVYISY 2458 | GAS 2459 | FGSSPF 2460 |
| 10 | 75110_01K10A | GFTFRNY 2489 | GTAGD 2490 | GGDYYYGMD 2491 | SQSLSSVY 2492 | GAS 2493 | YGSSPF 2494 |
| 11 | 75110_01L08A | GGSISHY 2523 | HYSGT 2524 | DQGFSSGGMD 2525 | SQDISNY 2526 | DAS 2527 | YDNLPL 2528 |
| 12 | 75110_01N04A | GFTFSNY 2557 | GTAGD 2558 | GGDFYYGLD 2559 | SQSVSSVY 2560 | GAS 2561 | YGSSPF 2562 |
| 13 | 75110_02E08A | GGSISTY 2591 | YTSGD 2592 | DSGALYSWNYGDAFD 2593 | SQDISNY 2594 | AAS 2595 | HNSYPR 2596 |
| 14 | 75110_02E22A | GGSISSF 2625 | YTSGS 2626 | ELEKRNYYGMD 2627 | SHDISNY 2628 | DAS 2629 | YDSLPL 2630 |
| 15 | 75110_02I16A | GGSFSGY 2659 | NHSGT 2660 | ELNWFD 2661 | SQDIANW 2662 | AAS 2663 | ANSFPY 2664 |
| 16 | 75110_02I18A | GFTFSSY 2693 | GTAGD 2694 | GGYYYYGMD 2695 | SQSVSSSY 2696 | GAS 2697 | YGSSPF 2698 |
| 17 | 75110_02K11A | GGSISSGFY 2727 | SYSGN 2728 | DRPSNFDAFD 2729 | SQSVSTSY 2730 | GAS 2731 | YGRSPL 2732 |
| 18 | 75110_02N15A | GFTFSSY 2761 | NEDGNE 2762 | EGGQWLALD 2763 | SQGISSW 2764 | GAS 2765 | ANSFPW 2766 |
| 19 | 75110_03B16A | GFTFSSY 2795 | NEDGSE 2796 | EGGQWLALD 2797 | SQGIRSW 2798 | GAS 2799 | ANSFPW 2800 |
| 20 | 75110_03C01A | GGSFSGY 2829 | NQSGS 2830 | VINWFD 2831 | SQGISSW 2832 | DAS 2833 | ANSFPY 2834 |
| 21 | 75110_03D16A | GFTFSSY 2863 | NQDGGE 2864 | EGGQWLALD 2865 | SQGISSW 2866 | AAS 2867 | ANSFPW 2868 |
| 22 | 75110_03I08A | GGSISSY 2897 | YYSGS 2898 | EGEQWFYGLD 2899 | SQSVSSTY 2900 | GSS 2901 | YGNSFPI 2902 |
| 23 | 75110_03I23A | GGSITSY 2931 | YTSGS 2932 | DPGYSDAFN 2933 | SQDISNY 2934 | DAS 2935 | CDNLPL 2936 |
| 24 | 75110_03L12A | GGSFSGY 2965 | NHSGS 2966 | LINWFD 2967 | SQDISNW 2968 | AAS 2969 | ANSFPY 2970 |
| 25 | 75110_04B08A | GFNFINY 2999 | WYDGSK 3000 | EDDWNDGLA 3001 | SQDIRND 3002 | AAS 3003 | DSNYPR 3004 |

TABLE 13-continued

Chothia CDR Amino Acid Sequences of CD4 Antibodies

| # | Protein Name | HC Chothia CDR1 | HC Chothia CDR2 | HC Chothia CDR3 | LC Chothia CDR1 | LC Chothia CDR2 | LC Chothia CDR3 |
|---|---|---|---|---|---|---|---|
| 26 | 75110_04D20A | NGSISDY 3033 | YTSGS 3034 | ELERYYFYGVD 3035 | SQDISNY 3036 | AAS 3037 | YDSLPL 3038 |
| 27 | 75110_04F22A | GFTFSSY 3067 | GTAGD 3068 | GGYYYYGMD 3069 | SQSVYSSY 3070 | GAS 3071 | FGTSPF 3072 |
| 28 | 75110_04G02A | GFTFSNA 3101 | KSKTDGGT 3102 | GGWFGELWGPFD 3103 | SQSVLYSSNNKNY 3104 | WAS 3105 | YFGSFP 3106 |
| 29 | 75110_04G16A | GDSISSGYY 3135 | SYSGS 3136 | DRPSNFDAFD 3137 | SQSVGSTY 3138 | GAF 3139 | YGSSPL 3140 |
| 30 | 75110_04H17A | GGSISTY 3169 | YTSER 3170 | ELERPYYYGMD 3171 | SQDISNY 3172 | YAS 3173 | YDNLPL 3174 |
| 31 | 75110_04K10A | GFTFSSY 3203 | NQDGSE 3204 | EGGQWLSLD 3205 | SQGISSW 3206 | GVS 3207 | ANSFPW 3208 |
| 32 | 75110_04P06A | GFTFSNY 3237 | GTAGD 3238 | GGDYYYGMD 3239 | SQSLSSVY 3240 | GAS 3241 | YGSSPF 3242 |
| 33 | 75110_04P08A | GGSLSGY 3271 | NQSGS 3272 | VLNWFD 3273 | SQDISNW 3274 | AAS 3275 | ANSFPY 3276 |
| 34 | 75110_05A11A | GFTFSNT 3305 | KSKIDGGT 3306 | SGTYSSGWGLFD 3307 | SQDISNY 3308 | DTS 3309 | YDNLPF 3310 |
| 35 | 75110_05B13A | GGSFSGY 3339 | NHRGS 3340 | PDSNWFD 3341 | SQDISNW 3342 | AAS 3343 | ANSFPL 3344 |
| 36 | 75110_05E05A | GGSIGSY 3373 | YTSGS 3374 | DGGVGDSLD 3375 | SQSLLDSDDGNTY 3376 | TLS 3377 | HIEFPF 3378 |
| 37 | 75110_05E13A | GFSFSNA 3407 | ESKTDGGT 3408 | GGGFGLELYGFFD 3409 | SQSISSW 3410 | KAS 3411 | YNSYY 3412 |
| 38 | 75110_05F19A | GFTFSNY 3441 | GTAGD 3442 | GGYDYYGLD 3443 | SQSVSSTY 3444 | GAS 3445 | YGSSPF 3446 |
| 39 | 75110_05G15A | GGSISSGGY 3475 | YYSGS 3476 | DGYDYWYFD 3477 | SQSVSSSY 3478 | GAS 3479 | YGSSPY 3480 |
| 40 | 75110_05K11A | GFTFSSY 3509 | GTAGD 3510 | GGFYYYGMD 3511 | SQSVSNTY 3512 | GAS 3513 | HGSSPF 3514 |
| 41 | 75110_05L07A | GFTFSSY 3543 | NQDGSD 3544 | EGGQWLTLD 3545 | SQSVSSTY 3546 | GAS 3547 | YGSSPF 3548 |
| 42 | 75110_06C16A | GGSISDY 3577 | YSSGS 3578 | DREDYYYYGMD 3579 | SHDISNY 3580 | AAS 3581 | YDHLPL 3582 |
| 43 | 75110_06D16A | GGSFSGY 3611 | NHSGS 3612 | VLNWFD 3613 | SQDIADW 3614 | AAS 3615 | ANSFPY 3616 |
| 44 | 75110_06E14A | GGSISNY 3645 | YSSGN 3646 | DREDYYYYGMD 3647 | SQDISNY 3648 | GAS 3649 | YDSLPI 3650 |
| 45 | 75110_06G04A | GGSISSY 3679 | YISGS 3680 | ELERPYYYGMD 3681 | SQDISNY 3682 | NAS 3683 | YDNLPL 3684 |
| 46 | 75110_06K03A | GGSISTY 3713 | NTSGS 3714 | ELERYYYYGMD 3715 | SQDISNY 3716 | YAS 3717 | YDSLPL 3718 |
| 47 | 75110_07B16A | GGSFSGY 3747 | NQSGS 3748 | VINWFD 3749 | SQGISSW 3750 | DAS 3751 | ANSFPY 3752 |
| 48 | 75110_07E04A | GFTFSSY 3781 | GTAGD 3782 | GGYYYYGMD 3783 | SQSISSTY 3784 | GAS 3785 | YGSSPF 3786 |
| 49 | 75110_07H07A | GFTFSSY 3815 | KEEGSE 3816 | EGGQWLALD 3817 | SQGISSW 3818 | GAS 3819 | ANSFPW 3820 |
| 50 | 75110_07J02A | GFTFSSY 3849 | KEDGSE 3850 | DGSYSGYGMD 3851 | SQGIRND 3852 | AAS 3853 | DYNYPY 3854 |

TABLE 13-continued

Chothia CDR Amino Acid Sequences of CD4 Antibodies

| # | Protein Name | HC Chothia CDR1 | HC Chothia CDR2 | HC Chothia CDR3 | LC Chothia CDR1 | LC Chothia CDR2 | LC Chothia CDR3 |
|---|---|---|---|---|---|---|---|
| 51 | 75110_07J24A | GGSISSY 3883 | YTSGR 3884 | DEGPTDAFD 3885 | SQSLLDSDDGNTY 3886 | TLS 3887 | RIEFPF 3888 |
| 52 | 75110_07N04A | GVSSTSF 3917 | YTSGS 3918 | DPGYSDAFA 3919 | SQDISNY 3920 | DTS 3921 | YDNLPL 3922 |
| 53 | 75110_08A13A | GFIFSSY 3951 | KQDGSE 3952 | DNSYYYYGMD 3953 | SQGIRDD 3954 | AAS 3955 | HYNYPY 3956 |
| 54 | 75110_08D24A | GGSISGF 3985 | YTSEN 3986 | DREGYYYYGMD 3987 | SQDISNY 3988 | AAS 3989 | YDSLPI 3990 |
| 55 | 75110_08F20A | GGSISTY 4019 | CTTEN 4020 | DLERLNYYGMD 4021 | SQDISKY 4022 | DAS 4023 | YDSLPI 4024 |
| 56 | 75110_08G08A | GGSISTY 4053 | CTTEN 4054 | DLERLNYYGMD 4055 | SQDISNY 4056 | DAS 4057 | YDSLPI 4058 |
| 57 | 75110_08H06A | GFTFSNY 4087 | GTAGD 4088 | GGYDYYGMD 4089 | SQSITSIY 4090 | GAS 4091 | YGSSPF 4092 |
| 58 | 75110_08H11A | GFTFSSY 4121 | GTAGD 4122 | GGYSYYGMD 4123 | SQSVSSTY 4124 | GAS 4125 | FGSSPF 4126 |
| 59 | 75110_08K12A | GFTFSSY 4155 | GTAGD 4156 | GDYYYYGMD 4157 | SQSVSSTY 4158 | GAS 4159 | FGTSPF 4160 |
| 60 | 75110_08M20A | GGSISSY 4189 | YASGS 4190 | DREGYYYYGMD 4191 | SQDISKY 4192 | AAS 4193 | YDSLPI 4194 |
| 61 | 75110_09G15A | GFTFSDY 4223 | NQDGS 4224 | EGGQWLALD 4225 | SQGISSW 4226 | GAS 4227 | ANIFPW 4228 |
| 62 | 75110_09N20A | GFTFSSY 4257 | NEDGSE 4258 | EGGQWLALD 4259 | SQGISSW 4260 | AAS 4261 | ANSFPW 4262 |
| 63 | 75110_10K21A | GFTFSSY 4291 | KQDGSE 4292 | DRYDALD 4293 | SQGIRND 4294 | AAS 4295 | DYNYPY 4296 |
| 64 | 75110_10L22A | GFTFSSY 4325 | GTAGD 4326 | GNYFYYGVD 4327 | SQSVSSSY 4328 | GAS 4329 | YGISPF 4330 |
| 65 | 75110_10N21A | GFTFSSY 4359 | GTAGD 4360 | GGYYYYGMD 4361 | SQSFISSY 4362 | GAS 4363 | SGNSPF 4364 |
| 66 | 75110_10O16A | GFTFSNS 4393 | GTAGD 4394 | GGLYYYGMD 4395 | SQSVSSSY 4396 | GAS 4397 | FGSSPF 4398 |
| 67 | 75110_11D03A | GFTFSSY 4427 | NQDGNE 4428 | EGGQWLALD 4429 | SQGISSW 4430 | GAS 4431 | ANSFPW 4432 |
| 68 | 75110_12C19A | GFTFSSY 4461 | KEDGSD 4462 | EGGQWLALD 4463 | SQGISSW 4464 | GAS 4465 | ANSFPW 4466 |
| 69 | 75110_12H17A | GFTFSDY 4495 | KEDGNE 4496 | EGGQWLALD 4497 | SQGISSW 4498 | GAS 4499 | ANSFPW 4500 |
| 70 | 75110_12H19A | GFTFSSY 4529 | NEDGNE 4530 | EGGQWLALD 4531 | SQGISSW 4532 | GAS 4533 | ANSFPW 4534 |
| 71 | 75110_12K21A | GGSFSGY 4563 | NHSGS 4564 | VLNYFD 4565 | SPDIANW 4566 | AAS 4567 | ANSFPL 4568 |
| 72 | 75110_13C07A | GFTFSNY 4597 | GTAGD 4598 | GAYGYYGMD 4599 | SQSVSSSY 4600 | GAS 4601 | YGFSPF 4602 |
| 73 | 75110_13C13A | GGSFSGY 4631 | NHSGS 4632 | VLNFFD 4633 | SPGISNW 4634 | AAS 4635 | ANSFPL 4636 |
| 74 | 75110_13P21A | GGSFSGY 4665 | NHSGS 4666 | VLNYFD 4667 | SPDIANW 4668 | AAS 4669 | ANSFPL 4670 |
| 75 | 75110_13P22A | GGSFSGY 4699 | NQSGN 4700 | VLNWFD 4701 | SQGISDW 4702 | AAS 4703 | ANSFPY 4704 |

TABLE 13-continued

Chothia CDR Amino Acid Sequences of CD4 Antibodies

| # | Protein Name | HC Chothia CDR1 | HC Chothia CDR2 | HC Chothia CDR3 | LC Chothia CDR1 | LC Chothia CDR2 | LC Chothia CDR3 |
|---|---|---|---|---|---|---|---|
| 76 | 75110_14G10A | GFTFSSY 4733 | SSSSSY 4734 | ERGDDYGDYEGAFD 4735 | SQDISNY 4736 | DAS 4737 | YDNLPY 4738 |
| 77 | 75110_14H13A | GFTFSNY 4767 | GTAGD 4768 | GGDYYYGMD 4769 | SQSVSSSY 4770 | GAS 4771 | FGSSPF 4772 |
| 78 | 75110_14I16A | NGSISSY 4801 | YTSGS 4802 | DREDYYYGMD 4803 | SHDISNY 4804 | YAS 4805 | YDNLPL 4806 |
| 79 | 75110_14N19A | GGSISRY 4835 | CTSEN 4836 | ELERLNYYGMD 4837 | SQDISNY 4838 | DAS 4839 | YDTLPI 4840 |
| 80 | 75110_14P05A | GFTFSSY 4869 | GTAGD 4870 | GGFYYYGMD 4871 | SQSVSSSY 4872 | GAS 4873 | SGSSPF 4874 |
| 81 | 75110_14P08A | GDSIRSY 4903 | YASGS 4904 | DGGVGDSLD 4905 | SQSLLDSDDGNTY 4906 | TLS 4907 | RIEFPF 4908 |
| 82 | 75110_01A07A_2 | GGSIINY 4937 | YSSGS 4938 | EREAYLYYGLD 4939 | SQGITNY 4940 | VTS 4941 | HNNYPL 4942 |

TABLE 14

AbM CDR Amino Acid Sequences of CD4 Antibodies

| # | Protein Name | HC AbM CDR1 | HC AbM CDR2 | HC AbM CDR3 | LC AbM CDR1 | LC AbM CDR2 | LC AbM CDR3 |
|---|---|---|---|---|---|---|---|
| 1 | 75110_01A06A | GFTFSSYWMS 2189 | NINEDGNEKY 2190 | EGGQWLSLDY 2191 | RASQGISSWLA 2192 | GASSLQS 2193 | QQANSFPWT 2194 |
| 2 | 75110_01A07A_1 | GGSIINYYWS 2223 | RIYSSGSTN 2224 | EREAYLYYGLDV 2225 | QASDI GNYLN 2226 | DASNLET 2227 | QQYDSLPLT 2228 |
| 3 | 75110_01C18A | GFTVSSNYMN 2257 | VIYAGDNTY 2258 | EGGTTGAFDI 2259 | RASQGINSWLA 2260 | AASSLQS 2261 | QQGNSFPYT 2262 |
| 4 | 75110_01D24A | GGSFSGYYWS 2291 | EINHSGSTN 2292 | LVNWFDP 2293 | RASQDISNWLA 2294 | AASSLQT 2295 | QQANSFPYS 2296 |
| 5 | 75110_01E08A | GFTFNNYDMH 2325 | TIGTAGDTY 2326 | GGDYYYGMDV 2327 | RASQSVSSSYLA 2328 | GASSRAT 2329 | QQFGSSPFT 2330 |
| 6 | 75110_01G11A | GFTFSSYDMH 2359 | TIGTAGDTY 2360 | GGDYYYGMDV 2361 | RASQNTYSSYLA 2362 | GASNRAT 2363 | QQHGTSPFT 2364 |
| 7 | 75110_01H18A | GGSFSGYYWS 2393 | EINQSGSTN 2394 | VINWFDS 2395 | RASQGISSWLA 2396 | AASSFQS 2397 | QQANSFPYT 2398 |
| 8 | 75110_01I09A | GFTFSSYWMS 2427 | NTKEDGSDKY 2428 | EGGQWLALDY 2429 | RASQGISSWLA 2430 | GASSLQS 2431 | QQANSFPWT 2432 |
| 9 | 75110_01I17A | GFTFSSYDMH 2461 | TIGTADDTY 2462 | GGDYYYGMDV 2463 | RASQSVYISYLA 2464 | GASSRAT 2465 | QQFGSSPFT 2466 |
| 10 | 75110_01K10A | GFTFRNYDMH 2495 | TIGTAGDTY 2496 | GGDYYYGMDV 2497 | RASQSLSSVYLA 2498 | GASSRAT 2499 | QQYGSSPFT 2500 |
| 11 | 75110_01L08A | GGSISHYYWS 2529 | YIHYSGTTN 2530 | DQGFSSGGMDV 2531 | QASQDISNYLN 2532 | DASNLET 2533 | QQYDNLPLT 2534 |
| 12 | 75110_01N04A | GFTFSNYDMH 2563 | TIGTAGDTY 2564 | GGDFYYGLDV 2565 | RASQSVSSVYLA 2566 | GASSRAT 2567 | QQYGSSPFT 2568 |
| 13 | 75110_02E08A | GGSISTYYWT 2597 | RVYTSGDTN 2598 | DSGALYSWNYGDAFDI 2599 | RASQDISNYLA 2600 | AASSLQS 2601 | LQHNSYPRT 2602 |
| 14 | 75110_02E22A | GGSISSFYWS 2631 | RIYTSGSTN 2632 | ELEKRNYYGMDV 2633 | QASHDISNYLN 2634 | DASTLET 2635 | QQYDSLPLT 2636 |
| 15 | 75110_02I16A | GGSFSGYYWT 2665 | EINHSGTTN 2666 | ELNWFDP 2667 | RASQDIANWLA 2668 | AASSLLG 2669 | QQANSFPYT 2670 |

TABLE 14-continued

AbM CDR Amino Acid Sequences of CD4 Antibodies

| # | Protein Name | HC AbM CDR1 | HC AbM CDR2 | HC AbM CDR3 | LC AbM CDR1 | LC AbM CDR2 | LC AbM CDR3 |
|---|---|---|---|---|---|---|---|
| 16 | 75110_02118A | GFTFSSYDMH 2699 | TIGTAGDTY 2700 | GGYYYYGMDV 2701 | RASQSVSSSYLA 2702 | GASSRAT 2703 | QQYGSSPFT 2704 |
| 17 | 75110_02K11A | GGSISSGFYYWT 2733 | YISYSGNTY 2734 | DRPSNFDAFDI 2735 | RASQSVSTSYLA 2736 | GASSRAT 2737 | QQYGRSPLT 2738 |
| 18 | 75110_02N15A | GFTFSSYWMS 2767 | NINEDGNEKY 2768 | EGGQWLALDH 2769 | RASQGISSWLA 2770 | GASSLQS 2771 | QQANSFPWT 2772 |
| 19 | 75110_03B16A | GFTFSSYWMS 2801 | NINEDGSEKN 2802 | EGGQWLALDY 2803 | RASQGIRSWLA 2804 | GASSLQS 2805 | QQANSFPWT 2806 |
| 20 | 75110_03C01A | GGSFSGYYWS 2835 | EINQSGSTN 2836 | VINWFDS 2837 | RASQGISSWLA 2838 | DASSFQS 2839 | QQANSFPYT 2840 |
| 21 | 75110_03D16A | GFTFSSYWMS 2869 | NINQDGGEKY 2870 | EGGQWLALDY 2871 | RASQGISSWLT 2872 | AASSLQS 2873 | QQANSFPWT 2874 |
| 22 | 75110_03108A | GGSISSYYWS 2903 | YIYYSGSTN 2904 | EGEQWFYGLDV 2905 | RASQSVSSTYLA 2906 | GSSSRAT 2907 | QQYGNSFPIT 2908 |
| 23 | 75110_03123A | GGSITSYYWN 2937 | RIYTSGSTN 2938 | DPGYSDAFNI 2939 | QASQDISNYLN 2940 | DASNLET 2941 | QQCDNLPLT 2942 |
| 24 | 75110_03L12A | GGSFSGYYWS 2971 | EINHSGSTN 2972 | LINWFDP 2973 | RASQDISNWLA 2974 | AASSLQS 2975 | QQANSFPYT 2976 |
| 25 | 75110_04B08A | GFNFINYGIH 3005 | IIWYDGSKKY 3006 | EDDWNDGLAY 3007 | RASQDIRNDLG 3008 | AASNLQS 3009 | LQDSNYPRT 3010 |
| 26 | 75110_04D20A | NGSISDYYWS 3039 | RIYTSGSTN 3040 | ELERYYFYGVDV 3041 | QASQDISNYLN 3042 | AASNLET 3043 | QQYDSLPLT 3044 |
| 27 | 75110_04F22A | GFTFSSYDIH 3073 | TIGTAGDTY 3074 | GGYYYYGMDV 3075 | RASQSVYSSYLA 3076 | GASSRAT 3077 | QQFGTSPFT 3078 |
| 28 | 75110_04G02A | GFTFSNAWMS 3107 | RIKSKTDGGTTD 3108 | GGWFGELWGPFDI 3109 | KSSQSVLYSSNNKNYLA 3110 | WASARES 3111 | QQYFGSFPT 3112 |
| 29 | 75110_04G16A | GDSISSGYYWS 3141 | YISYSGSTY 3142 | DRPSNFDAFDI 3143 | RASQSVGSTYLA 3144 | GAFSRAT 3145 | QQYGSSPLT 3146 |
| 30 | 75110_04H17A | GGSISTYYWS 3175 | RIYTSERPN 3176 | ELERPYYYGMDV 3177 | QASQDISNYLN 3178 | YASNLET 3179 | QQYDNLPLT 3180 |
| 31 | 75110_04K10A | GFTFSSYWMS 3209 | NINQDGSEKY 3210 | EGGQWLSLDY 3211 | RASQGISSWLA 3212 | GVSSFQS 3213 | QQANSFPWT 3214 |
| 32 | 75110_04P06A | GFTFSNYDMH 3243 | TIGTAGDTY 3244 | GGDYYYGMDV 3245 | RASQSLSSVYLA 3246 | GASSRAT 3247 | QQYGSSPFT 3248 |
| 33 | 75110_04P08A | GGSLSGYYWS 3277 | EINQSGSTN 3278 | VLNWFDP 3279 | RASQDISNWLA 3280 | AASSLQS 3281 | QQANSFPYT 3282 |
| 34 | 75110_05A11A | GFTFSNTWMS 3311 | RIKSKIDGGTTD 3312 | SGTYSSGWGLFDY 3313 | QASQDISNYLN 3314 | DTSNLEA 3315 | QQYDNLPFT 3316 |
| 35 | 75110_05B13A | GGSFSGYYWT 3345 | EINHRGSTN 3346 | PDSNWFDP 3347 | RASQDISNWLA 3348 | AASSLQS 3349 | QQANSFPLT 3350 |
| 36 | 75110_05E05A | GGSIGSYYWS 3379 | RIYTSGSTN 3380 | DGGVGDSLDY 3381 | RSSQSLLDSDDGNTYLD 3382 | TLSYRAS 3383 | MQHIEFPFT 3384 |
| 37 | 75110_05E13A | GFSFSNAWMS 3413 | RVESKTDGGTTD 3414 | GGGFGLELYGFFDY 3415 | RASQSISSWLA 3416 | KASSLES 3417 | LQYNSYYT 3418 |
| 38 | 75110_05F19A | GFTFSNYDVH 3447 | TIGTAGDTY 3448 | GGYDYYGLDV 3449 | RASQSVSSTYLA 3450 | GASSRAT 3451 | QQYGSSPFT 3452 |

TABLE 14-continued

AbM CDR Amino Acid Sequences of CD4 Antibodies

| # | Protein Name | HC AbM CDR1 | HC AbM CDR2 | HC AbM CDR3 | LC AbM CDR1 | LC AbM CDR2 | LC AbM CDR3 |
|---|---|---|---|---|---|---|---|
| 39 | 75110_05G15A | GGSISSGGYFWS<br>3481 | CIYYSGSTY<br>3482 | DGYDYWYFDL<br>3483 | RASQSVSSSYLA<br>3484 | GASSRAT<br>3485 | QQYGSSPYT<br>3486 |
| 40 | 75110_05K11A | GFTFSSYDMH<br>3515 | TIGTAGDTY<br>3516 | GGFYYYGMDV<br>3517 | RASQSVSNTYLA<br>3518 | GASSRAT<br>3519 | QQHGSSPFT<br>3520 |
| 41 | 75110_05L07A | GFTFSSYWMS<br>3549 | NINQDGSDKY<br>3550 | EGGQWLTLDY<br>3551 | RASQSVSSTYLA<br>3552 | GASSRAT<br>3553 | QQYGSSPFT<br>3554 |
| 42 | 75110_06C16A | GGSISDYYWS<br>3583 | RIYSSGSTN<br>3584 | DREDYYYYGMDV<br>3585 | QASHDISNYLN<br>3586 | AASNLET<br>3587 | QQYDHLPLT<br>3588 |
| 43 | 75110_06D16A | GGSFSGYYWS<br>3617 | EINHSGSTN<br>3618 | VLNWFDP<br>3619 | RASQDIADWLA<br>3620 | AASSFQS<br>3621 | QQANSFPYT<br>3622 |
| 44 | 75110_06E14A | GGSISNYFWS<br>3651 | RIYSSGNTN<br>3652 | DREDYYYYGMDV<br>3653 | QASQDISNYLN<br>3654 | GASILET<br>3655 | QQYDSLPIT<br>3656 |
| 45 | 75110_06G04A | GGSISSYYWS<br>3685 | RIYISGSTN<br>3686 | ELERPYYYGMDV<br>3687 | QASQDISNYLN<br>3688 | NASTLET<br>3689 | QQYDNLPLT<br>3690 |
| 46 | 75110_06K03A | GGSISTYYWS<br>3719 | RINTSGSTT<br>3720 | ELERYYYYGMDV<br>3721 | QASQDISNYLN<br>3722 | YASILET<br>3723 | QQYDSLPLT<br>3724 |
| 47 | 75110_07B16A | GGSFSGYYWS<br>3753 | EINQSGSTN<br>3754 | VINWFDS<br>3755 | RASQGISSWLA<br>3756 | DASSFQS<br>3757 | QQANSFPYT<br>3758 |
| 48 | 75110_07E04A | GFTFSSYDMH<br>3787 | TIGTAGDTY<br>3788 | GGYYYYGMDV<br>3789 | RASQSISSTYLA<br>3790 | GASSRAT<br>3791 | QQYGSSPFT<br>3792 |
| 49 | 75110_07H07A | GFTFSSYWMS<br>3821 | NIKEEGSEKY<br>3822 | EGGQWLALDY<br>3823 | RASQGISSWLA<br>3824 | GASSLQS<br>3825 | QQANSFPWT<br>3826 |
| 50 | 75110_07J02A | GFTFSSYWMS<br>3855 | NIKEDGSEKY<br>3856 | DGSYSGYGMDV<br>3857 | RASQGIRNDLG<br>3858 | AASSLQS<br>3859 | LLDYNYPYT<br>3860 |
| 51 | 75110_07J24A | GGSISSYYYN<br>3889 | RIYTSGRTD<br>3890 | DEGPTDAFDI<br>3891 | RSSQSLLDSDDGNTYLD<br>3892 | TLSYRAS<br>3893 | MQRIEFPFT<br>3894 |
| 52 | 75110_07N04A | GVSSTSFYWS<br>3923 | RIYTSGSTN<br>3924 | DPGYSDAFAI<br>3925 | QASQDISNYLT<br>3926 | DTSNLET<br>3927 | QQYDNLPLT<br>3928 |
| 53 | 75110_08A13A | GFIFSSYWMS<br>3957 | NIKQDGSEKY<br>3958 | DNSYYYYGMDV<br>3959 | RASQGIRDDLG<br>3960 | AASSLQS<br>3961 | LHHYNYPYT<br>3962 |
| 54 | 75110_08D24A | GGSISGFYWS<br>3991 | RIYTSENTN<br>3992 | DREGYYYYGMDV<br>3993 | QASQDISNYLN<br>3994 | AASNLET<br>3995 | QQYDSLPIT<br>3996 |
| 55 | 75110_08F20A | GGSISTYYWS<br>4025 | RICTTENTN<br>4026 | DLERLNYYGMDV<br>4027 | QASQDISKYLN<br>4028 | DASNLET<br>4029 | QQYDSLPIT<br>4030 |
| 56 | 75110_08G08A | GGSISTYYWS<br>4059 | RICTTENTN<br>4060 | DLERLNYYGMDV<br>4061 | QASQDISNYLN<br>4062 | DASNLET<br>4063 | QQYDSLPIT<br>4064 |
| 57 | 75110_08H06A | GFTFSNYDMH<br>4093 | TIGTAGDTY<br>4094 | GGYDYYGMDV<br>4095 | RASQSITSIYLA<br>4096 | GASSRAT<br>4097 | QQYGSSPFT<br>4098 |
| 58 | 75110_08H11A | GFTFSSYDMH<br>4127 | TIGTAGDTY<br>4128 | GGYSYYGMDV<br>4129 | GASQSVSSTYLA<br>4130 | GASSRAT<br>4131 | QQFGSSPFT<br>4132 |
| 59 | 75110_08K12A | GFTFSSYDMH<br>4161 | TIGTAGDTY<br>4162 | GDYYYYGMDV<br>4163 | RASQSVSSTYLA<br>4164 | GASNRAT<br>4165 | QQFGTSPFT<br>4166 |
| 60 | 75110_08M20A | GGSISSYYWS<br>4195 | RIYASGSTN<br>4196 | DREGYYYYGMDV<br>4197 | QASQDISKYLN<br>4198 | AASNLET<br>4199 | QQYDSLPIT<br>4200 |
| 61 | 75110_09G15A | GFTFSDYWMS<br>4229 | NINQDGSEK<br>4230 | EGGQWLALDY<br>4231 | RASQGISSWLA<br>4232 | GASSLQS<br>4233 | QQANIFPWT<br>4234 |
| 62 | 75110_09N20A | GFTFSSYWMS<br>4263 | NINEDGSEKY<br>4264 | EGGQWLALDY<br>4265 | RASQGISSWLA<br>4266 | AASSLQS<br>4267 | QQANSFPWT<br>4268 |

TABLE 14-continued

AbM CDR Amino Acid Sequences of CD4 Antibodies

| # | Protein Name | HC AbM CDR1 | HC AbM CDR2 | HC AbM CDR3 | LC AbM CDR1 | LC AbM CDR2 | LC AbM CDR3 |
|---|---|---|---|---|---|---|---|
| 63 | 75110_10K21A | GFTFSSYWMT 4297 | NIKQDGSEKY 4298 | DRYDALDI 4299 | RASQGIRNDLN 4300 | AASSLQS 4301 | LKDYNYPYT 4302 |
| 64 | 75110_10L22A | GFTFSSYDMH 4331 | TIGTAGDTY 4332 | GNYFYYGVDV 4333 | RASQSVSSSYLA 4334 | GASSRAT 4335 | QQYGISPFT 4336 |
| 65 | 75110_10N21A | GFTFSSYDMH 4365 | TIGTAGDTY 4366 | GGYYYYGMDV 4367 | RASQSFISSYLA 4368 | GASSRAT 4369 | QQSGNSPFT 4370 |
| 66 | 75110_10O16A | GFTFSNSDMH 4399 | TIGTAGDTY 4400 | GGLYYYGMDV 4401 | RASQSVSSSYLA 4402 | GASSRAT 4403 | HQFGSSPFT 4404 |
| 67 | 75110_11D03A | GFTFSSYWMS 4433 | NINQDGNEKY 4434 | EGGQWLALDY 4435 | RASQGISSWLA 4436 | GASSLQS 4437 | QQANSFPWT 4438 |
| 68 | 75110_12C19A | GFTFSSYWMS 4467 | NIKEDGSDKY 4468 | EGGQWLALDY 4469 | RASQGISSWLA 4470 | GASSLQS 4471 | QQANSFPWT 4472 |
| 69 | 75110_12H17A | GFTFSDYWMS 4501 | NIKEDGNEKY 4502 | EGGQWLALDY 4503 | RASQGISSWLA 4504 | GASSLQS 4505 | QQANSFPWT 4506 |
| 70 | 75110_12H19A | GFTFSSYWMS 4535 | NINEDGNEKY 4536 | EGGQWLALDY 4537 | RASQGISSWLA 4538 | GASGLQS 4539 | QQANSFPWT 4540 |
| 71 | 75110_12K21A | GGSFSGYYWS 4569 | EINHSGSTN 4570 | VLNYFDY 4571 | RASPDIANWLA 4572 | AASSLQS 4573 | QQANSFPLT 4574 |
| 72 | 75110_13C07A | GFTFSNYDMH 4603 | TIGTAGDTY 4604 | GAYGYYGMDV 4605 | RASQSVSSSYLA 4606 | GASSRAT 4607 | QQYGFSPFT 4608 |
| 73 | 75110_13C13A | GGSFSGYYWS 4637 | EINHSGSTN 4638 | VLNFFDY 4639 | RASPGISNWLA 4640 | AASSLQS 4641 | QQANSFPLT 4642 |
| 74 | 75110_13P21A | GGSFSGYYWS 4671 | EINHSGSTN 4672 | VLNYFDY 4673 | RASPDIANWLA 4674 | AASSLQS 4675 | QQANSFPLT 4676 |
| 75 | 75110_13P22A | GGSFSGYYWS 4705 | EINQSGNTN 4706 | VLNWFDY 4707 | RASQGISDWLA 4708 | AASSLQS 4709 | QQANSFPYT 4710 |
| 76 | 75110_14G10A | GFTFSSYSMN 4739 | FISSSSSYIY 4740 | ERGDDYGDYEGAFDI 4741 | QASQDISNYLN 4742 | DASNLET 4743 | QQYDNLPYT 4744 |
| 77 | 75110_14H13A | GFTFSNYDMH 4773 | TIGTAGDTY 4774 | GGDYYYGMDV 4775 | RASQSVSSSYLA 4776 | GASSRAT 4777 | QQFGSSPFT 4778 |
| 78 | 75110_14I16A | NGSISSYYWS 4807 | RIYTSGSTN 4808 | DREDYYYYGMDV 4809 | QASHDISNYLN 4810 | YASNLET 4811 | QQYDNLPLT 4812 |
| 79 | 75110_14N19A | GGSISRYYWS 4841 | RICTSENPN 4842 | ELERLNYYGMDV 4843 | QASQDISNYLN 4844 | DASNLES 4845 | QQYDTLPIT 4846 |
| 80 | 75110_14P05A | GFTFSSYDVH 4875 | TIGTAGDTY 4876 | GGFYYYGMDV 4877 | RASQSVSSSYLA 4878 | GASSRAT 4879 | QQSGSSPFT 4880 |
| 81 | 75110_14P08A | GDSIRSYYWN 4909 | RIYASGSTN 4910 | DGGVGDSLDY 4911 | RSSQSLLDSDDGNTYLD 4912 | TLSYRAS 4913 | MQRIEFPFT 4914 |
| 82 | 75110_01A07A_2 | GGSIINYYWS 4943 | RIYSSGSTN 4944 | EREAYLYYGLDV 4945 | RASQGITNYLA 4946 | VTSSFQS 4947 | LQHNNYPLT 4948 |

TABLE 15

Contact CDR Amino Acid Sequences of CD4 Antibodies

| # | Protein Name | HC Contact CDR1 | HC Contact CDR2 | HC Contact CDR3 | LC Contact CDR1 | LC Contact CDR2 | LC Contact CDR3 |
|---|---|---|---|---|---|---|---|
| 1 | 75110_01A06A | SSYWMS 2195 | WVANINEDGNEKY 2196 | AREGGQWLSLD 2197 | SSWLAWY 2198 | ILIYGASSLQ 2199 | QQANSFPW 2200 |

TABLE 15-continued

Contact CDR Amino Acid Sequences of CD4 Antibodies

| # | Protein Name | HC Contact CDR1 | HC Contact CDR2 | HC Contact CDR3 | LC Contact CDR1 | LC Contact CDR2 | LC Contact CDR3 |
|---|---|---|---|---|---|---|---|
| 2 | 75110_01A07A_1 | INYYWS 2229 | WIGRIYSSGSTN 2230 | AREREAYLYYGLD 2231 | GNYLNWY 2232 | LLIYDASNLE 2233 | QQYDSLPL 2234 |
| 3 | 75110_01C18A | SSNYMN 2263 | WVSVIYAGDNTY 2264 | AREGGTTGAFD 2265 | NSWLAWY 2266 | LLIYAASSLQ 2267 | QQGNSFPY 2268 |
| 4 | 75110_01D24A | SGYYWS 2297 | WIGEINHSGSTN 2298 | ARLVNWFD 2299 | SNWLAWY 2300 | LLIFAASSLQ 2301 | QQANSFPY 2302 |
| 5 | 75110_01E08A | NNYDMH 2331 | WVSTIGTAGDTY 2332 | ARGGDYYYGMD 2333 | SSSYLAWY 2334 | LLIYGASSRA 2335 | QQFGSSPF 2336 |
| 6 | 75110_01G11A | SSYDMH 2365 | WVSTIGTAGDTY 2366 | ARGGDYYYGMD 2367 | YSSYLAWY 2368 | LLIYGASNRA 2369 | QQHGTSPF 2370 |
| 7 | 75110_01H18A | SGYYWS 2399 | WIGEINQSGSTN 2400 | ARVINWFD 2401 | SSWLAWY 2402 | LLIYAASSFQ 2403 | QQANSFPY 2404 |
| 8 | 75110_01I09A | SSYWMS 2433 | WVANTKEDGSDKY 2434 | AREGGQWLALD 2435 | SSWLAWY 2436 | LLIFGASSLQ 2437 | QQANSFPW 2438 |
| 9 | 75110_01I17A | SSYDMH 2467 | WVSTIGTADDTY 2468 | ARGGDYYYGMD 2469 | YISYLAWY 2470 | LLIYGASSRA 2471 | QQFGSSPF 2472 |
| 10 | 75110_01K10A | RNYDMH 2501 | WVSTIGTAGDTY 2502 | ARGGDYYYGMD 2503 | SSVYLAWY 2504 | LLIYGASSRA 2505 | QQYGSSPF 2506 |
| 11 | 75110_01L08A | SHYYWS 2535 | WIGYIHYSGTTN 2536 | ARDQGFSSGGMD 2537 | SNYLNWY 2538 | LLIYDASNLE 2539 | QQYDNLPL 2540 |
| 12 | 75110_01N04A | SNYDMH 2569 | WVSTIGTAGDTY 2570 | ARGGDFYYGLD 2571 | SSVYLAWY 2572 | LLIYGASSRA 2573 | QQYGSSPF 2574 |
| 13 | 75110_02E08A | STYYWT 2603 | WIGRVYTSGDTN 2604 | ARDSGALYSWNYGDAFD 2605 | SNYLAWF 2606 | RLIYAASSLQ 2607 | LQHNSYPR 2608 |
| 14 | 75110_02E22A | SSFYWS 2637 | WIGRIYTSGSTN 2638 | ARELEKRNYYGMD 2639 | SNYLNWY 2640 | LLIFDASTLE 2641 | QQYDSLPL 2642 |
| 15 | 75110_02I16A | SGYYWT 2671 | WIGEINHSGTTN 2672 | TRELNWFD 2673 | ANWLAWY 2674 | LLIYAASSLL 2675 | QQANSFPY 2676 |
| 16 | 75110_02I18A | SSYDMH 2705 | WVSTIGTAGDTY 2706 | ARGGYYYYGMD 2707 | SSSYLAWY 2708 | LLIHGASSRA 2709 | QQYGSSPF 2710 |
| 17 | 75110_02K11A | SSGFYYWT 2739 | WIGYISYSGNTY 2740 | ARDRPSNFDAFD 2741 | STSYLAWY 2742 | LLIYGASSRA 2743 | QQYGRSPL 2744 |
| 18 | 75110_02N15A | SSYWMS 2773 | WVANINEDGNEKY 2774 | AREGGQWLALD 2775 | SSWLAWY 2776 | FLISGASSLQ 2777 | QQANSFPW 2778 |
| 19 | 75110_03B16A | SSYWMS 2807 | WVANINEDGSEKN 2808 | AREGGQWLALD 2809 | RSWLAWY 2810 | LLICGASSLQ 2811 | QQANSFPW 2812 |
| 20 | 75110_03C01A | SGYYWS 2841 | WIGEINQSGSTN 2842 | ARVINWFD 2843 | SSWLAWY 2844 | LLIYDASSFQ 2845 | QQANSFPY 2846 |
| 21 | 75110_03D16A | SSYWMS 2875 | WVANINQDGGEKY 2876 | VREGGQWLALD 2877 | SSWLTWY 2878 | FLIYAASSLQ 2879 | QQANSFPW 2880 |
| 22 | 75110_03I08A | SSYYWS 2909 | WIGYIYYSGSTN 2910 | AREGEQWFYGLD 2911 | SSTYLAWY 2912 | LLIYGSSSRA 2913 | QQYGNSFPI 2914 |
| 23 | 75110_03I23A | TSYYWN 2943 | WIGRIYTSGSTN 2944 | ARDPGYSDAFN 2945 | SNYLNWY 2946 | LLIYDASNLE 2947 | QQCDNLPL 2948 |
| 24 | 75110_03L12A | SGYYWS 2977 | WIGEINHSGSTN 2978 | VRLINWFD 2979 | SNWLAWY 2980 | LLIFAASSLQ 2981 | QQANSFPY 2982 |
| 25 | 75110_04B08A | INYGIH 3011 | WVTIIWYDGSKKY 3012 | AREDDWNDGLA 3013 | RNDLGWY 3014 | LLIYAASNLQ 3015 | LQDSNYPR 3016 |

TABLE 15-continued

Contact CDR Amino Acid Sequences of CD4 Antibodies

| # | Protein Name | HC Contact CDR1 | HC Contact CDR2 | HC Contact CDR3 | LC Contact CDR1 | LC Contact CDR2 | LC Contact CDR3 |
|---|---|---|---|---|---|---|---|
| 26 | 75110_04D20A | SDYYWS 3045 | WIGRIYTSGSTN 3046 | ARELERYYFYGVD 3047 | SNYLNWY 3048 | LLIYAASNLE 3049 | QQYDSLPL 3050 |
| 27 | 75110_04F22A | SSYDIH 3079 | WVSTIGTAGDTY 3080 | ARGGYYYYGMD 3081 | YSSYLAWY 3082 | LLIYGASSRA 3083 | QQFGTSPF 3084 |
| 28 | 75110_04G02A | SNAWMS 3113 | WVGRIKSKIDGGITD 3114 | TTGGWFGELWGPFD 3115 | LYSSNNKNYLAWY 3116 | LLFYWASARE 3117 | QQYFGSFP 3118 |
| 29 | 75110_04G16A | SSGYYWS 3147 | WIGYISYSGSTY 3148 | ARDRPSNFDAFD 3149 | GSTYLAWY 3150 | LLIYGAFSRA 3151 | QQYGSSPL 3152 |
| 30 | 75110_04H17A | STYYWS 3181 | WIGRIYTSERPN 3182 | ARELERPYYYGMD 3183 | SNYLNWY 3184 | LLIYYASNLE 3185 | QQYDNLPL 3186 |
| 31 | 75110_04K10A | SSYWMS 3215 | WVANINQDGSEKY 3216 | AREGGQWLSLD 3217 | SSWLAWY 3218 | VLIYGVSSFQ 3219 | QQANSFPW 3220 |
| 32 | 75110_04P06A | SNYDMH 3249 | WVSTIGTAGDTY 3250 | ARGGDYYYGMD 3251 | SSVYLAWY 3252 | LLIYGASSRA 3253 | QQYGSSPF 3254 |
| 33 | 75110_04P08A | SGYYWS 3283 | WIGEINQSGSTN 3284 | TRVLNWFD 3285 | SNWLAWY 3286 | LLIYAASSLQ 3287 | QQANSFPY 3288 |
| 34 | 75110_05A11A | SNTWMS 3317 | WVGRIKSKIDGGTTD 3318 | TTSGTYSSGWGLFD 3319 | SNYLNWY 3320 | LLIYDTSNLE 3321 | QQYDNLPF 3322 |
| 35 | 75110_05B13A | SGYYWT 3351 | WIGEINHRGSTN 3352 | TRPDSNWFD 3353 | SNWLAWY 3354 | LLIFAASSLQ 3355 | QQANSFPL 3356 |
| 36 | 75110_05E05A | GSYYWS 3385 | WIGRIYTSGSTN 3386 | ATDGGVGDSLD 3387 | LDSDDGNTYLDWY 3388 | LLIYTLSYRA 3389 | MQHIEFPF 3390 |
| 37 | 75110_05E13A | SNAWMS 3419 | WVGRVESKTDGGTTD 3420 | TIGGGFGLELYGFFD 3421 | SSWLAWY 3422 | LLIYKASSLE 3423 | LQYNSYY 3424 |
| 38 | 75110_05F19A | SNYDVH 3453 | WVSTIGTAGDTY 3454 | ARGGYDYYGLD 3455 | SSTYLAWY 3456 | LLIFGASSRA 3457 | QQYGSSPF 3458 |
| 39 | 75110_05G15A | SSGGYFWS 3487 | WIGCIYYSGSTY 3488 | ARDGYDYWYFD 3489 | SSSYLAWY 3490 | LLIYGASSRA 3491 | QQYGSSPY 3492 |
| 40 | 75110_05K11A | SSYDMH 3521 | WVSTIGTAGDTY 3522 | ARGGFYYYGMD 3523 | SNTYLAWY 3524 | LLIYGASSRA 3525 | QQHGSSPF 3526 |
| 41 | 75110_05L07A | SSYWMS 3555 | WVANINQDGSDKY 3556 | AREGGQWLTLD 3557 | SSTYLAWY 3558 | LLIFGASSRA 3559 | QQYGSSPF 3560 |
| 42 | 75110_06C16A | SDYYWS 3589 | WIGRIYSSGSTN 3590 | ARDREDYYYYGMD 3591 | SNYLNWY 3592 | LLIYAASNLE 3593 | QQYDHLPL 3594 |
| 43 | 75110_06D16A | SGYYWS 3623 | WIGEINHSGSTN 3624 | ARVLNWFD 3625 | ADWLAWY 3626 | LLIYAASSFQ 3627 | QQANSFPY 3628 |
| 44 | 75110_06E14A | SNYFWS 3657 | WIGRIYSSGNTN 3658 | ARDREDYYYYGMD 3659 | SNYLNWY 3660 | LLIYGASILE 3661 | QQYDSLPI 3662 |
| 45 | 75110_06G04A | SSYYWS 3691 | WIGRIYISGSTN 3692 | ARELERPYYYGMD 3693 | SNYLNWY 3694 | LLIYNASTLE 3695 | QQYDNLPL 3696 |
| 46 | 75110_06K03A | STYYWS 3725 | WIGRINTSGSTT 3726 | ARELERYYYYGMD 3727 | SNYLNWY 3728 | LLIYYASILE 3729 | QQYDSLPL 3730 |
| 47 | 75110_07B16A | SGYYWS 3759 | WIGEINQSGSTN 3760 | ARVINWFD 3761 | SSWLAWY 3762 | LLIYDASSFQ 3763 | QQANSFPY 3764 |
| 48 | 75110_07E04A | SSYDMH 3793 | WVSTIGTAGDTY 3794 | ARGGYYYYGMD 3795 | SSTYLAWY 3796 | LLIYGASSRA 3797 | QQYGSSPF 3798 |
| 49 | 75110_07H07A | SSYWMS 3827 | WVANIKEEGSEKY 3828 | VREGGQWLALD 3829 | SSWLAWY 3830 | LLIFGASSLQ 3831 | QQANSFPW 3832 |

TABLE 15-continued

Contact CDR Amino Acid Sequences of CD4 Antibodies

| # | Protein Name | HC Contact CDR1 | HC Contact CDR2 | HC Contact CDR3 | LC Contact CDR1 | LC Contact CDR2 | LC Contact CDR3 |
|---|---|---|---|---|---|---|---|
| 50 | 75110_07J02A | SSYWMS 3861 | WVANIKEDGSEKY 3862 | ARDGSYSGYGMD 3863 | RNDLGWY 3864 | LLIYAASSLQ 3865 | LLDYNYPY 3866 |
| 51 | 75110_07J24A | SSYYN 3895 | WIGRIYTSGRTD 3896 | ARDEGPTDAFD 3897 | LDSDDGNTYLDWY 3898 | LLIYTLSYRA 3899 | MQRIEFPF 3900 |
| 52 | 75110_07N04A | TSFYWS 3929 | WIGRIYTSGSTN 3930 | ARDPGYSDAFA 3931 | SNYLTWY 3932 | LLIYDTSNLE 3933 | QQYDNLPL 3934 |
| 53 | 75110_08A13A | SSYWMS 3963 | WVANIKQDGSEKY 3964 | ARDNSYYYGMD 3965 | RDDLGWY 3966 | LLIFAASSLQ 3967 | LHHYNYPY 3968 |
| 54 | 75110_08D24A | SGFYWS 3997 | WIGRIYTSENTN 3998 | ARDREGYYYYGMD 3999 | SNYLNWY 4000 | LLIYAASNLE 4001 | QQYDSLPI 4002 |
| 55 | 75110_08F20A | STYYWS 4031 | WIGRICTTENTN 4032 | ARDLERLNYYGMD 4033 | SKYLNWY 4034 | LLIYDASNLE 4035 | QQYDSLPI 4036 |
| 56 | 75110_08G08A | STYYWS 4065 | WIGRICTTENTN 4066 | ARDLERLNYYGMD 4067 | SNYLNWY 4068 | LLIYDASNLE 4069 | QQYDSLPI 4070 |
| 57 | 75110_08H06A | SNYDMH 4099 | WVSTIGTAGDTY 4100 | ARGGYDYYGMD 4101 | TSIYLAWY 4102 | LLIYGASSRA 4103 | QQYGSSPF 4104 |
| 58 | 75110_08H11A | SSYDMH 4133 | WVSTIGTAGDTY 4134 | ARGGYSYYGMD 4135 | SSTYLAWY 4136 | LLIYGASSRA 4137 | QQFGSSPF 4138 |
| 59 | 75110_08K12A | SSYDMH 4167 | WVSTIGTAGDTY 4168 | ARGDYYYGMD 4169 | SSTYLAWY 4170 | LLIYGASNRA 4171 | QQFGTSPF 4172 |
| 60 | 75110_08M20A | SSYYWS 4201 | WIGRIYASGSTN 4202 | ARDREGYYYYGMD 4203 | SKYLNWY 4204 | LLIYAASNLE 4205 | QQYDSLPI 4206 |
| 61 | 75110_09G15A | SDYWMS 4235 | WVANINQDGSEK 4236 | AREGGQWLALD 4237 | SSWLAWY 4238 | LLIYGASSLQ 4239 | QQANIFPW 4240 |
| 62 | 75110_09N20A | SSYWMS 4269 | WVANINEDGSEKY 4270 | VREGGQWLALD 4271 | SSWLAWY 4272 | LLIYAASSLQ 4273 | QQANSFPW 4274 |
| 63 | 75110_10K21A | SSYWMT 4303 | WVANIKQDGSEKY 4304 | VRDRYDALD 4305 | RNDLNWY 4306 | LLIYAASSLQ 4307 | LKDYNYPY 4308 |
| 64 | 75110_10L22A | SSYDMH 4337 | WVSTIGTAGDTY 4338 | ARGNYFYYGVD 4339 | SSSYLAWY 4340 | LLIYGASSRA 4341 | QQYGISPF 4342 |
| 65 | 75110_10N21A | SSYDMH 4371 | WVSTIGTAGDTY 4372 | ARGGYYYYGMD 4373 | ISSYLAWY 4374 | LLIYGASSRA 4375 | QQSGNSPF 4376 |
| 66 | 75110_10O16A | SNSDMH 4405 | WVSTIGTAGDTY 4406 | ARGGLYYYGMD 4407 | SSSYLAWY 4408 | LLIYGASSRA 4409 | HQFGSSPF 4410 |
| 67 | 75110_11D03A | SSYWMS 4439 | WVANINQDGNEKY 4440 | AREGGQWLALD 4441 | SSWLAWY 4442 | FLISGASSLQ 4443 | QQANSFPW 4444 |
| 68 | 75110_12C19A | SSYWMS 4473 | WVANIKEDGSDKY 4474 | VREGGQWLALD 4475 | SSWLAWY 4476 | LLIYGASSLQ 4477 | QQANSFPW 4478 |
| 69 | 75110_12H17A | SDYWMS 4507 | WVANIKEDGNEKY 4508 | AREGGQWLALD 4509 | SSWLAWY 4510 | FLISGASSLQ 4511 | QQANSFPW 4512 |
| 70 | 75110_12H19A | SSYWMS 4541 | WVANINEDGNEKY 4542 | AREGGQWLALD 4543 | SSWLAWY 4544 | LLIYGASGLQ 4545 | QQANSFPW 4546 |
| 71 | 75110_12K21A | SGYYWS 4575 | WIGEINHSGSTN 4576 | ARVLNYFD 4577 | ANWLAWY 4578 | LLIYAASSLQ 4579 | QQANSFPL 4580 |
| 72 | 75110_13C07A | SNYDMH 4609 | WVSTIGTAGDTY 4610 | ARGAYGYYGMD 4611 | SSSYLAWY 4612 | LLIYGASSRA 4613 | QQYGFSPF 4614 |
| 73 | 75110_13C13A | SGYYWS 4643 | WIGEINHSGSTN 4644 | ARVLNFFD 4645 | SNWLAWY 4646 | LLIYAASSLQ 4647 | QQANSFPL 4648 |
| 74 | 75110_13P21A | SGYYWS 4677 | WIGEINHSGSTN 4678 | ARVLNYFD 4679 | ANWLAWY 4680 | LLIYAASSLQ 4681 | QQANSFPL 4682 |

TABLE 15-continued

Contact CDR Amino Acid Sequences of CD4 Antibodies

| # | Protein Name | HC Contact CDR1 | HC Contact CDR2 | HC Contact CDR3 | LC Contact CDR1 | LC Contact CDR2 | LC Contact CDR3 |
|---|---|---|---|---|---|---|---|
| 75 | 75110_13P22A | SGYYWS 4711 | WIGEINQSGNTN 4712 | ARVLNWFD 4713 | SDWLAWY 4714 | LLIFAASSLQ 4715 | QQANSFPY 4716 |
| 76 | 75110_14G10A | SSYSMN 4745 | WVSFISSSSSYIY 4746 | ARERGDDYGDYEGAFD 4747 | SNYLNWY 4748 | LLIYDASNLE 4749 | QQYDNLPY 4750 |
| 77 | 75110_14H13A | SNYDMH 4779 | WVSTIGTAGDTY 4780 | ARGGDYYYGMD 4781 | SSSYLAWY 4782 | LLIYGASSRA 4783 | QQFGSSPF 4784 |
| 78 | 75110_14I16A | SSYYWS 4813 | WIGRIYTSGSTN 4814 | ARDREDYYYGMD 4815 | SNYLNWY 4816 | LLLYYASNLE 4817 | QQYDNLPL 4818 |
| 79 | 75110_14N19A | SRYYWS 4847 | WIGRICTSENPN 4848 | ARELERLNYYGMD 4849 | SNYLNWY 4850 | LLIYDASNLE 4851 | QQYDTLPI 4852 |
| 80 | 75110_14P05A | SSYDVH 4881 | WVSTIGTAGDTY 4882 | ARGGFYYYGMD 4883 | SSSYLAWY 4884 | LLIYGASSRA 4885 | QQSGSSPF 4886 |
| 81 | 75110_14P08A | RSYYWN 4915 | WIGRIYASGSTN 4916 | ARDGGVGDSLD 4917 | LDSDDGNTYLDWY 4918 | LLIYTLSYRA 4919 | MQRIEFPF 4920 |
| 82 | 75110_01A07A_2 | INYYWS 4949 | WIGRIYSSGSTN 4950 | AREREAYLYYGLD 4951 | TNYLAWF 4952 | RLIYVTS SFQ 4953 | LQHNNYPL 4954 |

TABLE 16

IMGT CDR Amino Acid Sequences of CD4 Antibodies

| # | Protein Name | HC IMGT CDR1 | HC IMGT CDR2 | HC IMGT CDR3 | LC IMGT CDR1 | LC IMGT CDR2 | LC IMGT CDR3 |
|---|---|---|---|---|---|---|---|
| 1 | 75110_01A06A | GFTFSSYW 2201 | INEDGNEK 2202 | AREGGQWLSLDY 2203 | QGISSW 2204 | GAS 2205 | QQANSFPWT 2206 |
| 2 | 75110_01A07A_1 | GGSIINYY 2235 | IYSSGST 2236 | AREREAYLYYGLDV 2237 | QDIGNY 2238 | DAS 2239 | QQYDSLPLT 2240 |
| 3 | 75110_01C18A | GFTVSSNY 2269 | IYAGDNT 2270 | AREGGTTGAFDI 2271 | QGINSW 2272 | AAS 2273 | QQGNSFPYT 2274 |
| 4 | 75110_01D24A | GGSFSGYY 2303 | INHSGST 2304 | ARLVNWFDP 2305 | QDISNW 2306 | AAS 2307 | QQANSFPYS 2308 |
| 5 | 75110_01E08A | GFTFNNYD 2337 | IGTAGDT 2338 | ARGGDYYYGMDV 2339 | QSVSSSY 2340 | GAS 2341 | QQFGSSPFT 2342 |
| 6 | 75110_01G11A | GFTFSSYD 2371 | IGTAGDT 2372 | ARGGDYYYGMDV 2373 | QNTYSSY 2374 | GAS 2375 | QQHGTSPFT 2376 |
| 7 | 75110_01H18A | GGSFSGYY 2405 | INQSGST 2406 | ARVINWFDS 2407 | QGISSW 2408 | AAS 2409 | QQANSFPYT 2410 |
| 8 | 75110_01I09A | GFTFSSYW 2439 | TKEDGSDK 2440 | AREGGQWLALDY 2441 | QGISSW 2442 | GAS 2443 | QQANSFPWT 2444 |
| 9 | 75110_01I17A | GFTFSSYD 2473 | IGTADDT 2474 | ARGGDYYYGMDV 2475 | QSVYISY 2476 | GAS 2477 | QQFGSSPFT 2478 |
| 10 | 75110_01K10A | GFTFRNYD 2507 | IGTAGDT 2508 | ARGGDYYYGMDV 2509 | QSLSSVY 2510 | GAS 2511 | QQYGSSPFT 2512 |
| 11 | 75110_01L08A | GGSISHYY 2541 | IHYSGTT 2542 | ARDQGFSSGGMDV 2543 | QDISNY 2544 | DAS 2545 | QQYDNLPLT 2546 |
| 12 | 75110_01N04A | GFTFSNYD 2575 | IGTAGDT 2576 | ARGGDFYYGLDV 2577 | QSVSSVY 2578 | GAS 2579 | QQYGSSPFT 2580 |
| 13 | 75110_02E08A | GGSISTYY 2609 | VYTSGDT 2610 | ARDSGALYSWNYGDAFDI 2611 | QDISNY 2612 | AAS 2613 | LQHNSYPRT 2614 |

TABLE 16-continued

IMGT CDR Amino Acid Sequences of CD4 Antibodies

| # | Protein Name | HC IMGT CDR1 | HC IMGT CDR2 | HC IMGT CDR3 | LC IMGT CDR1 | LC IMGT CDR2 | LC IMGT CDR3 |
|---|---|---|---|---|---|---|---|
| 14 | 75110_02E22A | GGSISSFY 2643 | IYTSGST 2644 | ARELEKRNYYGMDV 2645 | HDISNY 2646 | DAS 2647 | QQYDSLPLT 2648 |
| 15 | 75110_02I16A | GGSFSGYY 2677 | INHSGTT 2678 | TRELNWFDP 2679 | QDIANW 2680 | AAS 2681 | QQANSFPYT 2682 |
| 16 | 75110_02I18A | GFTFSSYD 2711 | IGTAGDT 2712 | ARGGYYYYGMDV 2713 | QSVSSSY 2714 | GAS 2715 | QQYGSSPFT 2716 |
| 17 | 75110_02K11A | GGSISSGFY 2745 | ISYSGNT 2746 | ARDRPSNFDAFDI 2747 | QSVSTSY 2748 | GAS 2749 | QQYGRSPLT 2750 |
| 18 | 75110_02N15A | GFTFSSYW 2779 | INEDGNEK 2780 | AREGGQWLALDH 2781 | QGISSW 2782 | GAS 2783 | QQANSFPWT 2784 |
| 19 | 75110_03B16A | GFTFSSYW 2813 | INEDGSEK 2814 | AREGGQWLALDY 2815 | QGIRSW 2816 | GAS 2817 | QQANSFPWT 2818 |
| 20 | 75110_03C01A | GGSFSGYY 2847 | INQSGST 2848 | ARVINWFDS 2849 | QGISSW 2850 | DAS 2851 | QQANSFPYT 2852 |
| 21 | 75110_03D16A | GFTFSSYW 2881 | INQDGGEK 2882 | VREGGQWLALDY 2883 | QGISSW 2884 | AAS 2885 | QQANSFPWT 2886 |
| 22 | 75110_03I08A | GGSISSYY 2915 | IYYSGST 2916 | AREGEQWFYGLDV 2917 | QSVSSTY 2918 | GSS 2919 | QQYGNSFPIT 2920 |
| 23 | 75110_03I23A | GGSITSYY 2949 | IYTSGST 2950 | ARDPGYSDAFNI 2951 | QDISNY 2952 | DAS 2953 | QQCDNLPLT 2954 |
| 24 | 75110_03L12A | GGSFSGYY 2983 | INHSGST 2984 | VRLINWFDP 2985 | QDISNW 2986 | AAS 2987 | QQANSFPYT 2988 |
| 25 | 75110_04B08A | GFNFINYG 3017 | IWYDGSKK 3018 | AREDDWNDGLAY 3019 | QDIRND 3020 | AAS 3021 | LQDSNYPRT 3022 |
| 26 | 75110_04D20A | NGSISDYY 3051 | IYTSGST 3052 | ARELERYYFYGVDV 3053 | QDISNY 3054 | AAS 3055 | QQYDSLPLT 3056 |
| 27 | 75110_04F22A | GFTFSSYD 3085 | IGTAGDT 3086 | ARGGYYYYGMDV 3087 | QSVYSSY 3088 | GAS 3089 | QQFGTSPFT 3090 |
| 28 | 75110_04G02A | GFTFSNAW 3119 | IKSKTDGGTT 3120 | TTGGWFGELWGPFDI 3121 | QSVLYSSNNKNY 3122 | WAS 3123 | QQYFGSFPT 3124 |
| 29 | 75110_04G16A | GDSISSGYY 3153 | ISYSGST 3154 | ARDRPSNFDAFDI 3155 | QSVGSTY 3156 | GAF 3157 | QQYGSSPLT 3158 |
| 30 | 75110_04H17A | GGSISTYY 3187 | IYTSERP 3188 | ARELERPYYYGMDV 3189 | QDISNY 3190 | YAS 3191 | QQYDNLPLT 3192 |
| 31 | 75110_04K10A | GFTFSSYW 3221 | INQDGSEK 3222 | AREGGQWLSLDY 3223 | QGISSW 3224 | GVS 3225 | QQANSFPWT 3226 |
| 32 | 75110_04P06A | GFTFSNYD 3255 | IGTAGDT 3256 | ARGGDYYYGMDV 3257 | QSLSSVY 3258 | GAS 3259 | QQYGSSPFT 3260 |
| 33 | 75110_04P08A | GGSLSGYY 3289 | INQSGST 3290 | TRVLNWFDP 3291 | QDISNW 3292 | AAS 3293 | QQANSFPYT 3294 |
| 34 | 75110_05A11A | GFTFSNTW 3323 | IKSKIDGGTT 3324 | TTSGTYSSGWGLFDY 3325 | QDISNY 3326 | DTS 3327 | QQYDNLPFT 3328 |
| 35 | 75110_05B13A | GGSFSGYY 3357 | INHRGST 3358 | TRPDSNWFDP 3359 | QDISNW 3360 | AAS 3361 | QQANSFPLT 3362 |
| 36 | 75110_05E05A | GGSIGSYY 3391 | IYTSGST 3392 | ATDGGVGDSLDY 3393 | QSLLDSDDGNTY 3394 | TLS 3395 | MQHIEFPFT 3396 |
| 37 | 75110_05E13A | GFSFSNAW 3425 | VESKTDGGTT 3426 | TIGGGFGLELYGFFDY 3427 | QSISSW 3428 | KAS 3429 | LQYNSYYT 3430 |

TABLE 16-continued

IMGT CDR Amino Acid Sequences of CD4 Antibodies

| # | Protein Name | HC IMGT CDR1 | HC IMGT CDR2 | HC IMGT CDR3 | LC IMGT CDR1 | LC IMGT CDR2 | LC IMGT CDR3 |
|---|---|---|---|---|---|---|---|
| 38 | 75110_05F19A | GFTFSNYD 3459 | IGTAGDT 3460 | ARGGYDYYGLDV 3461 | QSVSSTY 3462 | GAS 3463 | QQYGSSPFT 3464 |
| 39 | 75110_05G15A | GGSISSGGYF 3493 | IYYSGST 3494 | ARDGYDYWYFDL 3495 | QSVSSSY 3496 | GAS 3497 | QQYGSSPYT 3498 |
| 40 | 75110_05K11A | GFTFSSYD 3527 | IGTAGDT 3528 | ARGGFYYYGMDV 3529 | QSVSNTY 3530 | GAS 3531 | QQHGSSPFT 3532 |
| 41 | 75110_05L07A | GFTFSSYW 3561 | INQDGSDK 3562 | AREGGQWLTLDY 3563 | QSVSSTY 3564 | GAS 3565 | QQYGSSPFT 3566 |
| 42 | 75110_06C16A | GGSISDYY 3595 | IYSSGST 3596 | ARDREDYYYYGMDV 3597 | HDISNY 3598 | AAS 3599 | QQYDHLPLT 3600 |
| 43 | 75110_06D16A | GGSFSGYY 3629 | INHSGST 3630 | ARVLNWFDP 3631 | QDIADW 3632 | AAS 3633 | QQANSFPYT 3634 |
| 44 | 75110_06E14A | GGSISNYF 3663 | IYSSGNT 3664 | ARDREDYYYYGMDV 3665 | QDISNY 3666 | GAS 3667 | QQYDSLPIT 3668 |
| 45 | 75110_06G04A | GGSISSYY 3697 | IYISGST 3698 | ARELERPYYYGMDV 3699 | QDISNY 3700 | NAS 3701 | QQYDNLPLT 3702 |
| 46 | 75110_06K03A | GGSISTYY 3731 | INTSGST 3732 | ARELERYYYYGMDV 3733 | QDISNY 3734 | YAS 3735 | QQYDSLPLT 3736 |
| 47 | 75110_07B16A | GGSFSGYY 3765 | INQSGST 3766 | ARVINWFDS 3767 | QGISSW 3768 | DAS 3769 | QQANSFPYT 3770 |
| 48 | 75110_07E04A | GFTFSSYD 3799 | IGTAGDT 3800 | ARGGYYYYGMDV 3801 | QSISSTY 3802 | GAS 3803 | QQYGSSPFT 3804 |
| 49 | 75110_07H07A | GFTFSSYW 3833 | IKEEGSEK 3834 | VREGGQWLALDY 3835 | QGISSW 3836 | GAS 3837 | QQANSFPWT 3838 |
| 50 | 75110_07J02A | GFTFSSYW 3867 | IKEDGSEK 3868 | ARDGSYSGYGMDV 3869 | QGIRND 3870 | AAS 3871 | LLDYNYPYT 3872 |
| 51 | 75110_07J24A | GGSISSYY 3901 | IYTSGRT 3902 | ARDEGPTDAFDI 3903 | QSLLDSDDGNTY 3904 | TLS 3905 | MQRIEFPFT 3906 |
| 52 | 75110_07N04A | GVSSTSFY 3935 | IYTSGST 3936 | ARDPGYSDAFAI 3937 | QDISNY 3938 | DTS 3939 | QQYDNLPLT 3940 |
| 53 | 75110_08A13A | GFIFSSYW 3969 | IKQDGSEK 3970 | ARDNSYYYYGMDV 3971 | QGIRDD 3972 | AAS 3973 | LHHYNYPYT 3974 |
| 54 | 75110_08D24A | GGSISGFY 4003 | IYTSENT 4004 | ARDREGYYYYGMDV 4005 | QDISNY 4006 | AAS 4007 | QQYDSLPIT 4008 |
| 55 | 75110_08F20A | GGSISTYY 4037 | ICTTENT 4038 | ARDLERLNYYGMDV 4039 | QDISKY 4040 | DAS 4041 | QQYDSLPIT 4042 |
| 56 | 75110_08G08A | GGSISTYY 4071 | ICTTENT 4072 | ARDLERLNYYGMDV 4073 | QDISNY 4074 | DAS 4075 | QQYDSLPIT 4076 |
| 57 | 75110_08H06A | GFTFSNYD 4105 | IGTAGDT 4106 | ARGGYDYYGMDV 4107 | QSITSIY 4108 | GAS 4109 | QQYGSSPFT 4110 |
| 58 | 75110_08H11A | GFTFSSYD 4139 | IGTAGDT 4140 | ARGGYSYYGMDV 4141 | QSVSSTY 4142 | GAS 4143 | QQFGSSPFT 4144 |
| 59 | 75110_08K12A | GFTFSSYD 4173 | IGTAGDT 4174 | ARGDYYYYGMDV 4175 | QSVSSTY 4176 | GAS 4177 | QQFGTSPFT 4178 |
| 60 | 75110_08M20A | GGSISSYY 4207 | IYASGST 4208 | ARDREGYYYYGMDV 4209 | QDISKY 4210 | AAS 4211 | QQYDSLPIT 4212 |
| 61 | 75110_09G15A | GFTFSDYW 4241 | INQDGSE 4242 | AREGGQWLALDY 4243 | QGISSW 4244 | GAS 4245 | QQANIFPWT 4246 |

TABLE 16-continued

IMGT CDR Amino Acid Sequences of CD4 Antibodies

| # | Protein Name | HC IMGT CDR1 | HC IMGT CDR2 | HC IMGT CDR3 | LC IMGT CDR1 | LC IMGT CDR2 | LC IMGT CDR3 |
|---|---|---|---|---|---|---|---|
| 62 | 75110_09N20A | GFTFSSYW 4275 | INEDGSEK 4276 | VREGGQWLALDY 4277 | QGISSW 4278 | AAS 4279 | QQANSFPWT 4280 |
| 63 | 75110_10K21A | GFTFSSYW 4309 | IKQDGSEK 4310 | VRDRYDALDI 4311 | QGIRND 4312 | AAS 4313 | LKDYNYPYT 4314 |
| 64 | 75110_10L22A | GFTFSSYD 4343 | IGTAGDT 4344 | ARGNYFYYGVDV 4345 | QSVSSSY 4346 | GAS 4347 | QQYGISPFT 4348 |
| 65 | 75110_10N21A | GFTFSSYD 4377 | IGTAGDT 4378 | ARGGYYYYGMDV 4379 | QSFISSY 4380 | GAS 4381 | QQSGNSPFT 4382 |
| 66 | 75110_10O16A | GFTFSNSD 4411 | IGTAGDT 4412 | ARGGLYYYGMDV 4413 | QSVSSSY 4414 | GAS 4415 | HQFGSSPFT 4416 |
| 67 | 75110_11D03A | GFTFSSYW 4445 | INQDGNEK 4446 | AREGGQWLALDY 4447 | QGISSW 4448 | GAS 4449 | QQANSFPWT 4450 |
| 68 | 75110_12C19A | GFTFSSYW 4479 | IKEDGSDK 4480 | VREGGQWLALDY 4481 | QGISSW 4482 | GAS 4483 | QQANSFPWT 4484 |
| 69 | 75110_12H17A | GFTFSDYW 4513 | IKEDGNEK 4514 | AREGGQWLALDY 4515 | QGISSW 4516 | GAS 4517 | QQANSFPWT 4518 |
| 70 | 75110_12H19A | GFTFSSYW 4547 | INEDGNEK 4548 | AREGGQWLALDY 4549 | QGISSW 4550 | GAS 4551 | QQANSFPWT 4552 |
| 71 | 75110_12K21A | GGSFSGYY 4581 | INHSGST 4582 | ARVLNYFDY 4583 | PDIANW 4584 | AAS 4585 | QQANSFPLT 4586 |
| 72 | 75110_13C07A | GFTFSNYD 4615 | IGTAGDT 4616 | ARGAYGYYGMDV 4617 | QSVSSSY 4618 | GAS 4619 | QQYGFSPFT 4620 |
| 73 | 75110_13C13A | GGSFSGYY 4649 | INHSGST 4650 | ARVLNFFDY 4651 | PGISNW 4652 | AAS 4653 | QQANSFPLT 4654 |
| 74 | 75110_13P21A | GGSFSGYY 4683 | INHSGST 4684 | ARVLNYFDY 4685 | PDIANW 4686 | AAS 4687 | QQANSFPLT 4688 |
| 75 | 75110_13P22A | GGSFSGYY 4717 | INQSGNT 4718 | ARVLNWFDY 4719 | QGISDW 4720 | AAS 4721 | QQANSFPYT 4722 |
| 76 | 75110_14G10A | GFTFSSYS 4751 | ISSSSSYI 4752 | ARERGDDYGDYEGAFDI 4753 | QDISNY 4754 | DAS 4755 | QQYDNLPYT 4756 |
| 77 | 75110_14H13A | GFTFSNYD 4785 | IGTAGDT 4786 | ARGGDYYYGMDV 4787 | QSVSSSY 4788 | GAS 4789 | QQFGSSPFT 4790 |
| 78 | 75110_14I16A | NGSISSYY 4819 | IYTSGST 4820 | ARDREDYYYYGMDV 4821 | HDISNY 4822 | YAS 4823 | QQYDNLPLT 4824 |
| 79 | 75110_14N19A | GGSISRYY 4853 | ICTSENP 4854 | ARELERLNYYGMDV 4855 | QDISNY 4856 | DAS 4857 | QQYDTLPIT 4858 |
| 80 | 75110_14P05A | GFTFSSYD 4887 | IGTAGDT 4888 | ARGGFYYYGMDV 4889 | QSVSSSY 4890 | GAS 4891 | QQSGSSPFT 4892 |
| 81 | 75110_14P08A | GDSIRSYY 4921 | IYASGST 4922 | ARDGGVGDSLDY 4923 | QSLLDSDDGNTY 4924 | TLS 4925 | MQRIEFPFT 4926 |
| 82 | 75110_01A07A_2 | GGSIINYY 4955 | IYSSGST 4956 | AREREAYLYYGLDV 4957 | QGITNY 4958 | VTS 4959 | LQHNNYPLT 4960 |

TABLE 17

CD4 Antibody Sequence Summary

| | | Heavy Chain | | | | | | | Light Chain | | | |
|---|---|---|---|---|---|---|---|---|---|---|---|---|
| Notes | Antibody | Type | V Gene | V % Match | D Gene | D % Match | J Gene | J % Match | Type | V Gene | V % Match | J Gene | J % Match |
| Sib1.1 | 75110_05F19A | VH | IGHV3-13 | 98.3% | IGHD2-15 | 100.0% | IGHJ6 | 96.2% | κ | IGKV3-20 | 99.3% | IGKJ3 | 100.0% |
| Sib1.2 | 75110_10O16A | VH | IGHV3-13 | 97.9% | | 100.0% | IGHJ6 | 100.0% | κ | IGKV3-20 | 97.6% | IGKJ3 | 100.0% |
| Sib1.3 | 75110_01K10A | VH | IGHV3-13 | 97.6% | IGHD3-10 | 100.0% | IGHJ6 | 100.0% | κ | IGKV3-20 | 97.9% | IGKJ3 | 100.0% |
| Sib1.4 | 75110_04P06A | VH | IGHV3-13 | 98.3% | IGHD3-10 | 100.0% | IGHJ6 | 100.0% | κ | IGKV3-20 | 97.9% | IGKJ3 | 100.0% |
| Sib1.5 | 75110_13C07A | VH | IGHV3-13 | 98.3% | IGHD3-10 | 100.0% | IGHJ6 | 100.0% | κ | IGKV3-20 | 99.0% | IGKJ3 | 100.0% |
| Sib1.6 | 75110_01G11A | VH | IGHV3-13 | 99.0% | IGHD3-16 | 100.0% | IGHJ6 | 100.0% | κ | IGKV3-20 | 95.5% | IGKJ3 | 100.0% |
| Sib1.7 | 75110_04F22A | VH | IGHV3-13 | 99.3% | IGHD3-16 | 100.0% | IGHJ6 | 100.0% | κ | IGKV3-20 | 98.6% | IGKJ3 | 97.4% |
| Sib1.8 | 75110_08H11A | VH | IGHV3-13 | 99.7% | IGHD3-16 | 100.0% | IGHJ6 | 98.2% | κ | IGKV3-20 | 99.0% | IGKJ3 | 100.0% |
| Sib1.9 | 75110_14H13A | VH | IGHV3-13 | 98.3% | IGHD3-16 | 100.0% | IGHJ6 | 100.0% | κ | IGKV3-20 | 99.7% | IGKJ3 | 100.0% |
| Sib1.10 | 75110_14P05A | VH | IGHV3-13 | 98.6% | IGHD3-16 | 100.0% | IGHJ6 | 100.0% | κ | IGKV3-20 | 98.6% | IGKJ3 | 97.4% |
| Sib1.11 | 75110_01E08A | VH | IGHV3-13 | 98.3% | | | IGHJ6 | 100.0% | κ | IGKV3-20 | 99.3% | IGKJ3 | 100.0% |
| Sib1.12 | 75110_01J17A | VH | IGHV3-13 | 97.9% | | | IGHJ6 | 98.2% | κ | IGKV3-20 | 97.9% | IGKJ3 | 100.0% |
| Sib1.13 | 75110_01N04A | VH | IGHV3-13 | 98.6% | | | IGHJ6 | 96.4% | κ | IGKV3-20 | 98.6% | IGKJ3 | 100.0% |
| Sib1.14 | 75110_02I18A | VH | IGHV3-13 | 99.0% | | | IGHJ6 | 100.0% | κ | IGKV3-20 | 97.9% | IGKJ3 | 100.0% |
| Sib1.15 | 75110_05K11A | VH | IGHV3-13 | 98.6% | | | IGHJ6 | 100.0% | κ | IGKV3-20 | 97.6% | IGKJ3 | 100.0% |
| Sib1.16 | 75110_07E04A | VH | IGHV3-13 | 97.9% | | | IGHJ6 | 100.0% | κ | IGKV3-20 | 99.3% | IGKJ3 | 100.0% |
| Sib1.17 | 75110_08H06A | VH | IGHV3-13 | 99.0% | | | IGHJ6 | 98.2% | κ | IGKV3-20 | 98.3% | IGKJ3 | 97.4% |
| Sib1.18 | 75110_08K12A | VH | IGHV3-13 | 98.6% | | | IGHJ6 | 98.3% | κ | IGKV3-20 | 98.3% | IGKJ3 | 100.0% |
| Sib1.19 | 75110_10L22A | VH | IGHV3-13 | 99.3% | | | IGHJ6 | 96.6% | κ | IGKV3-20 | 99.7% | IGKJ3 | 100.0% |
| Sib1.20 | 75110_10N21A | VH | IGHV3-13 | 99.3% | | | IGHJ6 | 100.0% | κ | IGKV3-20 | 98.3% | IGKJ3 | 97.4% |
| | 75110_05E13A | VH | IGHV3-15 | 96.7% | | 100.0% | IGHJ4 | 100.0% | κ | IGKV1-5 | 98.6% | IGKJ2 | 100.0% |
| | 75110_04G02A | VH | IGHV3-15 | 99.3% | IGHD3-10 | 100.0% | IGHJ3 | 100.0% | κ | IGKV4-1 | 96.7% | IGKJ2 | 100.0% |
| | 75110_05A11A | VH | IGHV3-15 | 98.7% | IGHD6-19 | 100.0% | IGHJ4 | 100.0% | κ | IGKV1-33 | 98.6% | IGKJ4 | 97.2% |
| | 75110_14G10A | VH | IGHV3-21 | 99.3% | IGHD4-17 | 100.0% | IGHJ3 | 100.0% | κ | IGKV1-33 | 100.0% | IGKJ2 | 100.0% |
| | 75110_04B08A | VH | IGHV3-33 | 96.3% | IGHD1-1 | 100.0% | IGHJ4 | 97.6% | κ | IGKV1-6 | 98.3% | IGKJ1 | 100.0% |
| | 75110_01C18A | VH | IGHV3-53 | 96.2% | IGHD1-7 | 100.0% | IGHJ3 | 100.0% | κ | IGKV1-12 | 98.9% | IGKJ2 | 100.0% |
| | 75110_07J02A | VH | IGHV3-7 | 99.7% | IGHD1-26 | 100.0% | IGHJ6 | 100.0% | κ | IGKV1-6 | 98.9% | IGKJ2 | 97.4% |
| | 75110_10K21A | VH | IGHV3-7 | 98.3% | IGHD3-16 | 100.0% | IGHJ3 | 98.0% | κ | IGKV1-6 | 98.2% | IGKJ2 | 100.0% |
| | 75110_08A13A | VH | IGHV3-7 | 98.6% | IGHD4-23 | 100.0% | IGHJ6 | 100.0% | κ | IGKV1-6 | 97.5% | IGKJ2 | 100.0% |
| Sib2.1 | 75110_01A06A | VH | IGHV3-7 | 98.3% | IGHD6-19 | 100.0% | IGHJ4 | 97.6% | κ | IGKV1-12 | 98.6% | IGKJ1 | 100.0% |
| Sib2.2 | 75110_01J09A | VH | IGHV3-7 | 97.3% | IGHD6-19 | 100.0% | IGHJ4 | 100.0% | κ | IGKV1-12 | 95.4% | IGKJ1 | 100.0% |
| Sib2.3 | 75110_02N15A | VH | IGHV3-7 | 97.6% | IGHD6-19 | 100.0% | IGHJ4 | 95.2% | κ | IGKV1-12 | 98.2% | IGKJ1 | 97.2% |
| Sib2.4 | 75110_03B16A | VH | IGHV3-7 | 96.3% | IGHD6-19 | 100.0% | IGHJ4 | 100.0% | κ | IGKV1-12 | 97.9% | IGKJ1 | 97.4% |
| Sib2.5 | 75110_03D16A | VH | IGHV3-7 | 98.6% | IGHD6-19 | 100.0% | IGHJ4 | 100.0% | κ | IGKV1-12 | 98.2% | IGKJ1 | 100.0% |
| Sib2.6 | 75110_04K10A | VH | IGHV3-7 | 98.6% | IGHD6-19 | 100.0% | IGHJ4 | 100.0% | κ | IGKV1-12 | 97.5% | IGKJ1 | 100.0% |
| Sib2.7 | 75110_07H07A | VH | IGHV3-7 | 98.3% | IGHD6-19 | 100.0% | IGHJ4 | 100.0% | κ | IGKV1-12 | 98.9% | IGKJ1 | 94.7% |
| Sib2.8 | 75110_09G15A | VH | IGHV3-7 | 97.6% | IGHD6-19 | 90.9% | IGHJ4 | 100.0% | κ | IGKV1-12 | 97.5% | IGKJ1 | 100.0% |
| Sib2.9 | 75110_09N20A | VH | IGHV3-7 | 98.6% | IGHD6-19 | 100.0% | IGHJ4 | 100.0% | κ | IGKV1-12 | 98.6% | IGKJ1 | 97.4% |
| Sib2.10 | 75110_11D03A | VH | IGHV3-7 | 98.3% | IGHD6-19 | 100.0% | IGHJ4 | 97.6% | κ | IGKV1-12 | 98.6% | IGKJ1 | 100.0% |
| Sib2.11 | 75110_12C19A | VH | IGHV3-7 | 98.3% | IGHD6-19 | 100.0% | IGHJ4 | 100.0% | κ | IGKV1-12 | 98.9% | IGKJ1 | 100.0% |
| Sib2.12 | 75110_12H17A | VH | IGHV3-7 | 98.0% | IGHD6-19 | 100.0% | IGHJ4 | 97.6% | κ | IGKV1-12 | 98.2% | IGKJ1 | 100.0% |
| Sib2.13 | 75110_12H19A | VH | IGHV3-7 | 96.6% | IGHD6-19 | 100.0% | IGHJ4 | 97.6% | κ | IGKV1-12 | 98.9% | IGKJ1 | 100.0% |
| | 75110_05L07A | VH | IGHV3-7 | 98.6% | IGHD6-19 | 100.0% | IGHJ4 | 100.0% | κ | IGKV3-20 | 99.3% | IGKJ3 | 100.0% |
| Sib3.1 | 75110_02K11A | VH | IGHV4-31 | 97.3% | | 100.0% | IGHJ3 | 100.0% | κ | IGKV3-20 | 99.0% | IGKJ3 | 100.0% |
| Sib3.2 | 75110_04G16A | VH | IGHV4-31 | 97.7% | | 100.0% | IGHJ3 | 100.0% | κ | IGKV3-20 | 99.0% | IGKJ3 | 100.0% |
| | 75110_05G15A | VH | IGHV4-31 | 98.3% | IGHD5-12 | 100.0% | IGHJ2 | 100.0% | κ | IGKV3-20 | 100.0% | IGKJ2 | 100.0% |
| | 75110_13P22A | VH | IGHV4-34 | 97.3% | IGHD1-1 | 100.0% | IGHJ4 | 97.7% | κ | IGKV1-12 | 96.8% | IGKJ2 | 100.0% |
| Sib4.1 (identical) | 75110_12K21A | VH | IGHV4-34 | 98.3% | | 100.0% | IGHJ4 | 100.0% | κ | IGKV1-12 | 97.2% | IGKJ4 | 97.2% |
| Sib4.1 (identical) | 75110_13P21A | VH | IGHV4-34 | 98.3% | | 100.0% | IGHJ4 | 100.0% | κ | IGKV1-12 | 97.2% | IGKJ4 | 97.2% |
| Sib4.2 | 75110_13C13A | VH | IGHV4-34 | 98.6% | | 100.0% | IGHJ4 | 97.9% | κ | IGKV1-12 | 97.2% | IGKJ4 | 97.2% |
| Sib5.1 | 75110_04P08A | VH | IGHV4-34 | 96.2% | | | IGHJ5 | 97.8% | κ | IGKV1-12 | 98.2% | IGKJ2 | 100.0% |
| Sib5.2 | 75110_06D16A | VH | IGHV4-34 | 99.3% | | | IGHJ5 | 100.0% | κ | IGKV1-12 | 97.5% | IGKJ2 | 97.4% |
| | 75110_03L12A | VH | IGHV4-34 | 98.3% | IGHD2-21 | 100.0% | IGHJ5 | 100.0% | κ | IGKV1-12 | 98.2% | IGKJ2 | 94.7% |
| | 75110_05B13A | VH | IGHV4-34 | 95.9% | IGHD2-21 | 100.0% | IGHJ5 | 100.0% | κ | IGKV1-12 | 97.9% | IGKJ4 | 100.0% |
| Sib6.1 | 75110_01H18A | VH | IGHV4-34 | 99.0% | IGHD3-10 | 100.0% | IGHJ5 | 97.8% | κ | IGKV1-12 | 98.6% | IGKJ2 | 97.4% |
| Sib6.2 | 75110_03C01A | VH | IGHV4-34 | 98.6% | IGHD3-10 | 100.0% | IGHJ5 | 95.7% | κ | IGKV1-12 | 97.2% | IGKJ2 | 100.0% |
| Sib6.3 | 75110_07B16A | VH | IGHV4-34 | 98.6% | IGHD3-10 | 100.0% | IGHJ5 | 95.7% | κ | IGKV1-12 | 97.9% | IGKJ2 | 100.0% |
| | 75110_01D24A | VH | IGHV4-34 | 99.3% | IGHD3-9 | 100.0% | IGHJ5 | 100.0% | κ | IGKV1-12 | 96.8% | IGKJ2 | 92.1% |
| | 75110_02I16A | VH | IGHV4-34 | 96.2% | | | IGHJ5 | 100.0% | κ | IGKV1-12 | 96.1% | IGKJ2 | 100.0% |
| Sib7.1 | 75110_02E22A | VH | IGHV4-4 | 99.3% | | 90.9% | IGHJ6 | 98.1% | κ | IGKV1-33 | 97.5% | IGKJ4 | 100.0% |
| Sib7.2 | 75110_04D20A | VH | IGHV4-4 | 96.6% | IGHD1-1 | 100.0% | IGHJ6 | 96.3% | κ | IGKV1-33 | 98.9% | IGKJ4 | 97.4% |
| Sib7.3 | 75110_04H17A | VH | IGHV4-4 | 96.2% | IGHD1-1 | 100.0% | IGHJ6 | 100.0% | κ | IGKV1-33 | 98.6% | IGKJ4 | 100.0% |
| Sib7.4 | 75110_06G04A | VH | IGHV4-4 | 97.3% | IGHD1-1 | 100.0% | IGHJ6 | 98.1% | κ | IGKV1-33 | 99.3% | IGKJ4 | 97.4% |
| Sib7.5 | 75110_06K03A | VH | IGHV4-4 | 98.0% | IGHD1-1 | 100.0% | IGHJ6 | 100.0% | κ | IGKV1-33 | 98.6% | IGKJ4 | 100.0% |
| Sib7.6 | 75110_06C16A | VH | IGHV4-4 | 96.6% | | | IGHJ6 | 100.0% | κ | IGKV1-33 | 97.9% | IGKJ4 | 100.0% |
| Sib7.7 | 75110_08F20A | VH | IGHV4-4 | 96.6% | IGHD1-1 | 100.0% | IGHJ6 | 98.1% | κ | IGKV1-33 | 98.2% | IGKJ5 | 97.4% |
| Sib7.8 | 75110_08G08A | VH | IGHV4-4 | 97.3% | IGHD1-1 | 100.0% | IGHJ6 | 98.1% | κ | IGKV1-33 | 98.9% | IGKJ5 | 97.4% |
| Sib7.9 | 75110_14N19A | VH | IGHV4-4 | 97.6% | IGHD1-1 | 100.0% | IGHJ6 | 100.0% | κ | IGKV1-33 | 97.5% | IGKJ5 | 97.4% |

TABLE 17-continued

CD4 Antibody Sequence Summary

| | | | Heavy Chain | | | | | | | Light Chain | | | |
|---|---|---|---|---|---|---|---|---|---|---|---|---|---|
| Notes | Antibody | Type | V Gene | V % Match | D Gene | D % Match | J Gene | J % Match | Type | V Gene | V % Match | J Gene | J % Match |
| Sib7.10 | 75110_06E14A | VH | IGHV4-4 | 98.0% | IGHD3-10 | 100.0% | IGHJ6 | 100.0% | κ | IGKV1-33 | 98.6% | IGKJ5 | 100.0% |
| | 75110_01A07A_1 | VH | IGHV4-4 | 96.60% | IGHD1-26 | 100.00% | IGHJ6 | 98.10% | κ | IGKV1-33 | 98.9% | IGKJ4 | 100.0% |
| | 75110_01A07A_2 | VH | IGHV4-4 | 96.60% | IGHD1-26 | 100.00% | IGHJ6 | 98.10% | κ | IGKV1-17 | 95.8% | IGKJ4 | 100.0% |
| | 75110_02E08A | VH | IGHV4-4 | 97.3% | IGHD1-7 | 93.3% | IGHJ3 | 100.0% | κ | IGKV1-17 | 99.7% | IGKJ1 | 100.0% |
| Sib8.1 | 75110_05E05A | VH | IGHV4-4 | 98.0% | IGHD3-16 | 100.0% | IGHJ4 | 100.0% | κ | IGKV2-40 | 99.7% | IGKJ3 | 100.0% |
| Sib8.2 | 75110_14P08A | VH | IGHV4-4 | 95.9% | IGHD3-16 | 100.0% | IGHJ4 | 100.0% | κ | IGKV2-40 | 100.0% | IGKJ3 | 100.0% |
| Sib9.1 | 75110_03I23A | VH | IGHV4-4 | 98.3% | IGHD5-18 | 100.0% | IGHJ3 | 98.0% | κ | IGKV1-33 | 98.9% | IGKJ4 | 100.0% |
| Sib9.2 | 75110_07N04A | VH | IGHV4-4 | 97.3% | IGHD5-18 | 100.0% | IGHJ3 | 98.0% | κ | IGKV1-33 | 99.3% | IGKJ4 | 100.0% |
| | 75110_07J24A | VH | IGHV4-4 | 96.9% | | | IGHJ3 | 100.0% | κ | IGKV2-40 | 98.3% | IGKJ3 | 100.0% |
| Sib10.1 | 75110_08D24A | VH | IGHV4-4 | 97.3% | | | IGHJ6 | 100.0% | κ | IGKV1-33 | 98.9% | IGKJ5 | 100.0% |
| Sib10.2 | 75110_08M20A | VH | IGHV4-4 | 99.0% | | | IGHJ6 | 100.0% | κ | IGKV1-33 | 98.2% | IGKJ5 | 100.0% |
| Sib10.3 | 75110_14I16A | VH | IGHV4-4 | 98.3% | | | IGHJ6 | 98.3% | κ | IGKV1-33 | 97.5% | IGKJ4 | 100.0% |
| | 75110_03I08A | VH | IGHV4-59 | 99.7% | IGHD6-19 | 100.0% | IGHJ6 | 98.0% | κ | IGKV3-20 | 98.3% | IGKJ5 | 100.0% |
| | 75110_01L08A | VH | IGHV4-59 | 97.6% | IGHD6-19 | 92.9% | IGHJ6 | 100.0% | κ | IGKV1-33 | 99.6% | IGKJ4 | 100.0% |

TABLE 18

Non-Clonal Supernantant Screening: FACS Analysis and Epitope Binning

| | Primary Screens | | Confirmation Screening-FACS | | | | SKW3 FACS Binning | | | ELISA Binning Ibalizumab ELISA Binning Experiment-100 ng/mL | |
|---|---|---|---|---|---|---|---|---|---|---|---|
| Hybridoma ID | SKW3 WT vs KO anti-mFc-647 | SKW3 WT vs KO anti-hKappa-FITC | SKW3 WT anti-mFc 647, gMFI (Bkrd gMFI = 3300) | SKW3 WT anti-hu Kappa FITC, gMFI (Bkrd gMFI = 2500) | PBMCs, anti-mFc 647 CD4+ gate-RL1 BInding | PBMCs, anti-mFc 647 CD4+ Percent Bound of Viable | OKT4 A488 Background-2163 Max Binding-8200 | RPA-T4-PE-Dazzle 594 Background-783 Max Binding-15000 | OKT4a anti-hu A647 Secondary Background-5000 Max Binding-35000 | huCD4-HIS-anti-HIS HRP detection Background-45 Max Binding-3000000 | BIN # |
| 75110_01A07A | 6.0 | 1.3 | 23745 | 4828 | 288876 | 35 | 6515 | 8738 | 42954 | 426129 | Ibalizumab |
| 75110_01L08A | 4.3 | 2.6 | 18705 | 5516 | 199655 | 27 | 9752 | 19766 | 9034 | 58214 | Ibalizumab |
| 75110_02I18A | 4.2 | 2.2 | 16461 | 5374 | 274874 | 29 | 9228 | 4414 | 44772 | 291057 | Ibalizumab |
| 75110_03I08A | 7.6 | 2.2 | 27994 | 6123 | 338421 | 32 | 11169 | 3351 | 24751 | 20349 | Ibalizumab |
| 75110_04G02A | 6.6 | 1.5 | 12037 | 4059 | 178405 | 27 | 9326 | 12125 | 22471 | 45 | Ibalizumab |
| 75110_05A11A | 3.4 | 1.8 | 24449 | 6615 | 246769 | 26 | 8161 | 17155 | 34999 | 45 | Ibalizumab |
| 75110_05E13A | 5.8 | 1.9 | 45600 | 8050 | 230515 | 26 | 9329 | 16525 | 36438 | 45 | Ibalizumab |
| 75110_05F19A | 10.6 | 2.8 | 42224 | 8509 | 280604 | 31 | 8923 | 15862 | 29952 | 45 | Ibalizumab |
| 75110_07J24A | 6.2 | 1.8 | 30855 | 5826 | 234133 | 33 | 7727 | 8463 | 33773 | 215326 | Ibalizumab |
| 75110_08A13A | 2.7 | 1.0 | 9181 | 3145 | 258187 | 29 | 7977 | 13340 | 42022 | 230020 | Ibalizumab |
| 75110_01C18A | 14.7 | 3.7 | 34887 | 6533 | 308040 | 31 | 9486 | 16530 | 36249 | 1783061 | No Bin |
| 75110_02E22A | 4.7 | 1.6 | 17328 | 4279 | 275723 | 31 | 8476 | 15295 | 41888 | 1861052 | No Bin |
| 75110_02K11A | 10.3 | 3.3 | 24783 | 6655 | 296309 | 29 | 8729 | 15815 | 32191 | 1992168 | No Bin |
| 75110_03I23A | 4.1 | 1.9 | 13809 | 5145 | 241454 | 28 | 9919 | 14048 | 15858 | 1258599 | No Bin |
| 75110_04D20A | 4.5 | 2.3 | 21903 | 6791 | 174317 | 28 | 7369 | 17146 | 29209 | 2105763 | No Bin |
| 75110_04H17A | 2.9 | 1.6 | 27204 | 7426 | 301981 | 30 | 9439 | 16792 | 33959 | 1893266 | No Bin |
| 75110_05E05A | 9.4 | 3.2 | 38765 | 8324 | 227125 | 28 | 9102 | 16458 | 35536 | 1640077 | No Bin |
| 75110_05G15A | 2.8 | 1.5 | 28623 | 5996 | 146777 | 32 | 8077 | 15844 | 42348 | 1702809 | No Bin |
| 75110_06C16A | 5 | 1.9 | 12105 | 4655 | 296555 | 28 | 8237 | 15634 | 36808 | 1353545 | No Bin |
| 75110_06E14A | 9.8 | 3.0 | 33848 | 8917 | 284855 | 30 | 9063 | 16399 | 31319 | 1767802 | No Bin |
| 75110_06G04A | 9.3 | 3.3 | 33736 | 8483 | 240424 | 30 | 9314 | 16585 | 30812 | 1959954 | No Bin |
| 75110_06K03A | 7.5 | 2.7 | 33550 | 8636 | 296312 | 32 | 9144 | 15793 | 33247 | 1645729 | No Bin |
| 75110_07J02A | 2.3 | 1.3 | 13428 | 3985 | 89171 | 27 | 8052 | 15914 | 38005 | 1982560 | No Bin |
| 75110_07N04A | 7.8 | 2.8 | 30416 | 6228 | 343981 | 30 | 9014 | 15544 | 36147 | 1655336 | No Bin |
| 75110_08D24A | 4.1 | 1.1 | 20074 | 3573 | 277834 | 30 | 7930 | 14626 | 42513 | 886728 | No Bin |
| 75110_08F20A | 3.1 | 1.7 | 31494 | 6169 | 253115 | 32 | 7408 | 15489 | 44792 | 1413451 | No Bin |
| 75110_08G08A | 5.7 | 2.4 | 19412 | 5845 | 313823 | 30 | 8890 | 16154 | 38446 | 1692071 | No Bin |
| 75110_08K12A | 4.7 | 1.7 | 16592 | 5299 | 276135 | 29 | 8657 | 16045 | 39153 | 1980865 | No Bin |
| 75110_08M20 | 7.2 | 3.2 | 31430 | 8253 | 319755 | 33 | 9018 | 15980 | 34986 | 1654771 | No Bin |
| 75110_08M20A | 8.8 | 2.7 | 30733 | 7786 | 318987 | 30 | 9132 | 16585 | 37201 | 908769 | No Bin |
| 75110_10O16A | 2.4 | 1.3 | 5461 | 3161 | 72092 | 23 | 8258 | 15348 | 34850 | 2374776 | No Bin |
| 75110_14G10A | 2.2 | 1.1 | 8911 | 3413 | 141601 | 32 | 8716 | 10141 | 41809 | 1208865 | No Bin |
| 75110_14I16A | 2.1 | 1.4 | 6820 | 3554 | 195816 | 23 | 8010 | 15315 | 32994 | 2258355 | No Bin |
| 75110_14N19A | 14.9 | 3.8 | 28628 | 7639 | 276795 | 29 | 9082 | 16644 | 29723 | 1283466 | No Bin |

TABLE 18-continued

Non-Clonal Supernatant Screening: FACS Analysis and Epitope Binning

| | Primary Screens | | Confirmation Screening-FACS | | | | SKW3 FACS Binning | | | ELISA Binning Ibalizumab ELISA Binning Experiment-100 ng/mL | |
|---|---|---|---|---|---|---|---|---|---|---|---|
| | | | SKW3 WT | SKW3 WT | PBMCs, | PBMCs, | | | | | |
| Hybridoma ID | SKW3 WT vs KO anti-mFc-647 | SKW3 WT vs KO anti-hKappa-FITC | anti-mFc 647, gMFI (Bkrd gMFI = 3300) | anti-hu Kappa FITC, gMFI (Bkrd gMFI = 2500) | anti-mFc 647 CD4+ gate-RL1 BInding | anti-mFc 647 CD4+ Percent Bound of Viable | OKT4 A488 Background-2163 Max Binding-8200 | RPA-T4-PE–Dazzle 594 Background-783 Max Binding-15000 | OKT4a anti-hu A647 Secondary Background-5000 Max Binding-35000 | huCD4-HIS-anti-HIS HRP detection Background-45 Max Binding-3000000 | BIN # |
| 75110_14P08A | 6.7 | 2.2 | 20284 | 5583 | 291529 | 30 | 9101 | 16418 | 38366 | 2202970 | No Bin |
| 75110_01E08A | 5.9 | 2.2 | 22891 | 6338 | 302344 | 29 | 3333 | 14425 | 43278 | 1840413 | OKT4 |
| 75110_02N15A | 4.9 | 2.1 | 15881 | 5004 | 249701 | 27 | 3025 | 14245 | 42862 | 1980299 | OKT4 |
| 75110_03B16A | 6.2 | 2.1 | 31230 | 6802 | 240617 | 30 | 2473 | 15076 | 45128 | 1466575 | OKT4 |
| 75110_03D16A | 6.5 | 2.8 | 36046 | 7596 | 318619 | 31 | 2278 | 12296 | 35873 | 662928 | OKT4 |
| 75110_04B08A | 6.7 | 2.3 | 22596 | 6157 | 274235 | 29 | 3166 | 14918 | 43367 | 1945825 | OKT4 |
| 75110_04K10A | 5 | 1.5 | 36741 | 6710 | 345723 | 33 | 2765 | 9805 | 43099 | 1126353 | OKT4 |
| 75110_05L07A | 3.9 | 1.5 | 16332 | 5130 | 180625 | 29 | 3125 | 15871 | 37399 | 2570319 | OKT4 |
| 75110_07H07A | 5.7 | 2.3 | 34268 | 8512 | 233585 | 27 | 2065 | 14937 | 39400 | 2111980 | OKT4 |
| 75110_09G15A | 4.8 | 2.0 | 22267 | 5806 | 304141 | 28 | 2989 | 14814 | 44604 | 1992168 | OKT4 |
| 75110_09N20A | 5.4 | 2.2 | 24812 | 5876 | 287063 | 33 | 2702 | 14679 | 46618 | 1761585 | OKT4 |
| 75110_10L22A | 3.4 | 2.1 | 27585 | 7020 | 283145 | 31 | 2849 | 14992 | 45900 | 1880832 | OKT4 |
| 75110_11D03A | 2.6 | 1.0 | 21089 | 3995 | 190309 | 29 | 4178 | 13148 | 43723 | 1628209 | OKT4 |
| 75110_12H17A | 4.0 | 2.0 | 17986 | 5355 | 263669 | 29 | 4018 | 14813 | 41996 | 2203535 | OKT4 |
| 75110_12H19A | 5.2 | 2.4 | 22813 | 6548 | 243836 | 27 | 2625 | 14638 | 34377 | 1736718 | OKT4 |
| 75110_01A06A | 7.5 | 2.4 | 32302 | 5927 | 321177 | 31 | 2135 | 14664 | 43658 | 1260294 | OKT4 |
| 75110_01J09A | 7.5 | 2.4 | 32302 | 5927 | 321177 | 31 | 2135 | 14664 | 43658 | 1260294 | OKT4 |
| 75110_02E08A | 8.4 | 3.1 | 30910 | 7262 | 316961 | 31 | 3317 | 13511 | 41534 | 334574 | OKT4/ Ibalizumab |
| 75110_03C01A | 8 | 2.4 | 18720 | 5915 | 265590 | 28 | 9511 | 19208 | 6982 | 865252 | OKT4a |
| 75110_03L12A | 4.2 | 2.5 | 27321 | 8013 | 229292 | 28 | 9752 | 20663 | 5715 | 885033 | OKT4a |
| 75110_04P08A | 8.4 | 3 | 25343 | 7415 | 259647 | 28 | 9759 | 19903 | 6063 | 1569433 | OKT4a |
| 75110_05B13A | 3.1 | 2.4 | 26022 | 7308 | 227873 | 27 | 9667 | 20253 | 5336 | 1031973 | OKT4a |
| 75110_06D16A | 4 | 2.5 | 41343 | 8670 | 215613 | 29 | 9980 | 21306 | 5795 | 1267076 | OKT4a |
| 75110_07B16A | 11.4 | 3.0 | 30754 | 7224 | 273723 | 29 | 9283 | 20578 | 5325 | 1307767 | OKT4a |
| 75110_12C19A | 7.2 | 2.3 | 29283 | 6850 | 340556 | 31 | 9584 | 11856 | 7138 | 1507831 | OKT4a |
| 75110_12K21A | 6.6 | 2.8 | 24953 | 5624 | 335494 | 30 | 10008 | 10885 | 8238 | 1412886 | OKT4a |
| 75110_13C13A | 6.8 | 3.1 | 23885 | 7239 | 99619 | 6 | 9763 | 20793 | 5495 | 1173261 | OKT4a |
| 75110_13P21A | 5.8 | 2.4 | 30903 | 7577 | 273616 | 31 | 9419 | 11860 | 6868 | 677622 | OKT4a |
| 75110_13P22A | 6.4 | 2.8 | 18171 | 5906 | 215437 | 27 | 9367 | 19027 | 6216 | 1160827 | OKT4a |
| 75110_14P05A | 4.6 | 2.8 | 24046 | 7515 | 186984 | 27 | 9340 | 20281 | 6113 | 709835 | OKT4a |
| 75110_01D24A | 6.8 | 2.5 | 24970 | 5516 | 257352 | 31 | 11113 | 15174 | 5320 | 20349 | OKT4a/ Ibalizumab |
| 75110_04G16A | 6.3 | 2.3 | 32522 | 6830 | 254923 | 32 | 9641 | 13543 | 6741 | 52562 | OKT4a/ Ibalizumab |
| 75110_01G11A | 3.4 | 2 | 19228 | 4998 | 243602 | 30 | 10116 | 2159 | 30137 | 495077 | RPA-14 |
| 75110_01J17A | 4.3 | 2.1 | 31576 | 5780 | 280451 | 32 | 10014 | 1951 | 37668 | 755048 | RPA-T4 |
| 75110_01K10A | 4.6 | 2.2 | 24264 | 5945 | 282834 | 30 | 10786 | 1513 | 29991 | 890119 | RPA-14 |
| 75110_01N04A | 3.7 | 1.9 | 27986 | 5635 | 209561 | 33 | 9721 | 2243 | 38092 | 1041580 | RPA-14 |
| 75110_02I16A | 3.0 | 1.7 | 19398 | 5736 | 217654 | 29 | 9808 | 2593 | 30654 | 822866 | RPA-14 |
| 75110_04F22A | 3.6 | 1.8 | 26941 | 5583 | 286484 | 32 | 9945 | 2293 | 40217 | 748266 | RPA-14 |
| 75110_04P06A | 3.9 | 1.6 | 24548 | 5601 | 292218 | 31 | 10076 | 2190 | 37441 | 1219603 | RPA-14 |
| 75110_05K11A | 4 | 1.8 | 35890 | 6704 | 266773 | 31 | 9727 | 2193 | 37616 | 1176652 | RPA-14 |
| 75110_07E04A | 2.9 | 1.8 | 21985 | 6360 | 206329 | 30 | 9944 | 2425 | 31343 | 1730502 | RPA-14 |
| 75110_08H06A | 3.0 | 1.6 | 22983 | 6272 | 224764 | 30 | 10404 | 2477 | 29907 | 1420798 | RPA-T4 |
| 75110_08H11A | 2.8 | 1.6 | 18557 | 5232 | 245967 | 31 | 9773 | 3091 | 35984 | 868643 | RPA-14 |
| 75110_10K21A | 2.6 | 1.7 | 19178 | 5846 | 223996 | 32 | 9978 | 2591 | 34061 | 292752 | RPA-14 |
| 75110_10N21A | 3.1 | 1.4 | 13042 | 4064 | 178782 | 33 | 9087 | 6881 | 40125 | 1575650 | RPA-14 |
| 75110_13C07A | 3.1 | 1.6 | 23131 | 5725 | 302782 | 35 | 9593 | 2508 | 38946 | 1703694 | RPA-14 |
| 75110_01H18A | 3.6 | 1.6 | 19013 | 4930 | 263045 | 32 | 9844 | 2826 | 37208 | 384872 | RPA-14/ Ibalizumab |
| 75110_14H13A | 4.8 | 1.9 | 21981 | 6013 | 292358 | 29 | 12694 | 1664 | 14284 | 2264 | RPA-14/ Ibalizumab |
| 75110_06L01A | 9.3 | 2.9 | 40372 | 9916 | 283047 | 33 | 9095 | 16482 | 33465 | 406913 | No Bin |
| 75110_07G23A | 11.6 | 2.7 | 31612 | 7302 | 301136 | 31 | 9270 | 15294 | 37135 | 2176973 | No Bin |
| 75110_09I11A | 4.9 | 2.0 | 15432 | 5432 | 141191 | 23 | 9809 | 3520 | 38995 | 1070403 | No Bin |
| 75110_09L24A | 4.9 | 1.1 | 10029 | 2979 | 80840 | 25 | 6389 | 14526 | 37420 | 2291699 | No Bin |
| 75110_02L13A | 7.2 | 2.5 | 24212 | 7610 | 266143 | 28 | 9692 | 19862 | 6092 | 1016148 | OKT4a |
| 75110_11F17A | 5.7 | 2.8 | 28445 | 8093 | 255713 | 28 | 9399 | 20938 | 6206 | 762960 | OKT4a |
| 75110_09K15A | 2.8 | 1.3 | 10726 | 3934 | 172113 | 28 | 8971 | 7526 | 37018 | 934201 | RPA-14 |

TABLE 19

| | | Nonclonal Supernatant Screening: Off-rate Screening | | | | |
|---|---|---|---|---|---|---|
| Hybridoma ID | Full R^2 | Antibody Loading (nm, estimated) | Response | KD (M) | kon (1/Ms) | kdis (1/s) |
| 75110_01A07A | 0.97 | 1.6 | 0.24 | 6.0E-09 | 1.4E+05 | 8.1E-04 |
| 75110_01L08A | 0.98 | 0.9 | 0.09 | 4.1E-09 | 9.1E+04 | 3.7E-04 |
| 75110_02I18A | 0.84 | 0.9 | 0.16 | 9.0E-09 | 3.7E+05 | 3.3E-03 |
| 75110_03I08A | 0.96 | 1 | 0.07 | <1.0E-12 | 3.7E+04 | <1.0E-07 |
| 75110_04G02A | 0.97 | 1 | 0.21 | 7.6E-10 | 2.2E+05 | 1.7E-04 |
| 75110_05A11A | 0.97 | 0.8 | 0.15 | 3.2E-09 | 1.7E+05 | 5.5E-04 |
| 75110_05E13A | 0.99 | 1 | 0.33 | 7.4E-09 | 1.6E+05 | 1.2E-03 |
| 75110_05F19A | 0.99 | 0.8 | 0.18 | 3.2E-11 | 1.4E+05 | 4.4E-06 |
| 75110_07J24A | 0.99 | 1.2 | 0.14 | <1.0E-12 | 7.7E+04 | <1.0E-07 |
| 75110_08A13A | 0.90 | 1.7 | 0.35 | 4.4E-09 | 2.3E+05 | 1.0E-03 |
| 75110_01C18A | 1.00 | 1 | 0.25 | 1.6E-08 | 8.6E+04 | 1.3E-03 |
| 75110_02E22A | 0.95 | 1 | 0.18 | 2.0E-08 | 2.1E+05 | 4.2E-03 |
| 75110_02K11A | 0.96 | 0.8 | 0.14 | 1.7E-08 | 1.3E+05 | 2.2E-03 |
| 75110_03I23A | 0.97 | 0.8 | 0.18 | 8.6E-09 | 1.4E+05 | 1.2E-03 |
| 75110_04D20A | 1.00 | 0.7 | 0.20 | 8.8E-10 | 1.5E+05 | 1.3E-04 |
| 75110_04H17A | 0.99 | 0.7 | 0.16 | 9.0E-09 | 1.1E+05 | 9.7E-04 |
| 75110_05E05A | 0.99 | 1 | 0.24 | 9.5E-10 | 1.4E+05 | 1.3E-04 |
| 75110_05G15A | 0.99 | 0.9 | 0.24 | <1.0E-12 | 7.8E+04 | <1.0E-07 |
| 75110_06C16A | 0.74 | 1.7 | 0.07 | 9.7E-09 | 2.5E+05 | 2.4E-03 |
| 75110_06E14A | 0.97 | 0.9 | 0.12 | 1.2E-08 | 1.7E+05 | 2.0E-03 |
| 75110_06G04A | 0.99 | 0.8 | 0.12 | 1.4E-08 | 7.5E+04 | 1.0E-03 |
| 75110_06K03A | 0.83 | 0.7 | 0.14 | 6.8E-09 | 2.8E+05 | 1.9E-03 |
| 75110_07J02A | 0.99 | 0.7 | 0.1303 | 5.60E-10 | 6.84E+04 | 3.83E-05 |
| 75110_07N04A | 0.90 | 0.4 | 0.10 | <1.0E-12 | 1.4E+05 | <1.0E-07 |
| 75110_08D24A | 0.99 | 1.5 | 0.21 | 3.4E-08 | 1.7E+05 | 6.0E-03 |
| 75110_08F20A | 0.99 | 1.1 | 0.32 | 1.9E-09 | 1.4E+05 | 2.6E-04 |
| 75110_08G08A | 0.82 | 0.8 | 0.13 | 3.4E-09 | 2.8E+05 | 9.6E-04 |
| 75110_08K12A | 0.73 | 0.8 | 0.11 | 4.5E-09 | 7.0E+05 | 3.1E-03 |
| 75110_08M20 | 0.99 | 1.1 | 0.11 | 3.9E-08 | 4.9E+04 | 1.9E-03 |
| 75110_08M20A | 0.93 | 1 | 0.19 | 3.6E-09 | 1.5E+05 | 5.3E-04 |
| 75110_10O16A | 0.95 | 0.7 | 0.0936 | <1.0E-12 | 6.48E+04 | <1.0E-07 |
| 75110_14G10A | 0.96 | 0.05 | 0.0363 | <1.0E-12 | 7.88E+04 | <1.0E-07 |
| 75110_14I16A | 0.74 | 0.8 | 0.0852 | <1.0E-12 | 4.27E+04 | <1.0E-07 |
| 75110_14N19A | 0.99 | 0.8 | 0.1049 | 1.92E-08 | 1.43E+05 | 2.74E-03 |
| 75110_14P08A | 0.90 | 0.5 | 0.0968 | 7.47E-09 | 1.79E+05 | 1.34E-03 |
| 75110_01E08A | 0.86 | 0.9 | 0.10 | 1.0E-08 | 1.4E+05 | 1.4E-03 |
| 75110_02N15A | 0.96 | 0.8 | 0.16 | 6.7E-09 | 1.0E+05 | 6.9E-04 |
| 75110_03B16A | 0.98 | 1.2 | 0.19 | 1.5E-08 | 1.8E+05 | 2.7E-03 |
| 75110_03D16A | 0.93 | 0.7 | 0.25 | 6.0E-09 | 2.2E+05 | 1.3E-03 |
| 75110_04B08A | 0.83 | 0.5 | 0.14 | 5.2E-09 | 2.3E+05 | 1.2E-03 |
| 75110_04K10A | 0.92 | 1 | 0.23 | 6.3E-09 | 2.9E+05 | 1.8E-03 |
| 75110_05L07A | 0.95 | 1.3 | 0.12 | 1.3E-08 | 1.0E+05 | 1.4E-03 |
| 75110_07H07A | 0.99 | 0.8 | 0.20 | 3.1E-09 | 1.1E+05 | 3.5E-04 |
| 75110_09G15A | 0.95 | 1 | 0.10 | 2.9E-07 | 3.7E+04 | 1.1E-02 |
| 75110_09N20A | 0.95 | 0.7 | 0.13 | 1.5E-08 | 1.3E+05 | 1.9E-03 |
| 75110_10L22A | 0.9962 | 0.9 | 0.1127 | 1.17E-07 | 5.57E+04 | 6.50E-03 |
| 75110_11D03A | 0.9899 | 0.95 | 0.1774 | 4.67E-09 | 1.12E+05 | 5.24E-04 |
| 75110_12H17A | 0.80 | 0.9 | 0.09 | 9.6E-09 | 3.3E+05 | 3.2E-03 |
| 75110_12H19A | 0.90 | 0.05 | 0.09 | 4.2E-09 | 2.9E+05 | 1.2E-03 |
| 75110_01A06A | 1.00 | 1.3 | 0.28 | 1.1E-08 | 1.2E+05 | 1.3E-03 |
| 75110_01J09A | 1.00 | 1.3 | 0.28 | 1.1E-08 | 1.2E+05 | 1.3E-03 |
| 75110_02E08A | 0.45 | 0.7 | 0.08 | 1.5E-09 | 3.3E+05 | 5.1E-04 |
| 75110_03C01A | 0.96 | 0.25 | 0.09 | <1.0E-12 | 1.5E+05 | <1.0E-07 |
| 75110_03L12A | 0.99 | 0.8 | 0.21 | 2.8E-09 | 1.7E+05 | 4.8E-04 |
| 75110_04P08A | 0.99 | 0.6 | 0.17 | 1.8E-09 | 1.2E+05 | 2.2E-04 |
| 75110_05B13A | 0.64 | 1.2 | 0.03 | <1.0E-12 | 2.0E+05 | <1.0E-07 |
| 75110_06D16A | 0.94 | 1.1 | 0.09 | 2.5E-09 | 1.9E+05 | 4.7E-04 |
| 75110_07B16A | 0.99 | 0.7 | 0.21 | 7.9E-10 | 1.6E+05 | 1.3E-04 |
| 75110_12C19A | 0.99 | 0.6 | 0.1056 | 6.27E-10 | 1.54E+05 | 9.63E-05 |
| 75110_12K21A | 0.86 | 1.5 | 0.26 | 3.0E-09 | 2.0E+05 | 6.0E-04 |
| 75110_13C13A | 0.99 | 0.9 | 0.19 | 3.2E-09 | 1.6E+05 | 5.1E-04 |
| 75110_13P21A | 0.98 | 1 | 0.1201 | 2.04E-09 | 1.54E+05 | 3.15E-04 |
| 75110_13P22A | 0.99 | 0.7 | 0.24 | 6.8E-10 | 1.9E+05 | 1.3E-04 |
| 75110_14P05A | 1.00 | 1 | 0.1491 | 1.23E-08 | 1.50E+05 | 1.85E-03 |
| 75110_01D24A | 0.99 | 1.3 | 0.26 | 1.1E-09 | 1.1E+05 | 1.3E-04 |
| 75110_04G16A | 0.99 | 1.6 | 0.15 | 9.5E-10 | 7.4E+04 | 7.1E-05 |
| 75110_01G11A | 0.94 | 0.95 | 0.04 | 5.3E-09 | 4.7E+04 | 2.5E-04 |
| 75110_01J17A | 0.95 | 0.9 | 0.06 | <1.0E-12 | 3.7E+04 | <1.0E-07 |
| 75110_01K10A | 0.89 | 1 | 0.03 | 3.4E-07 | 1.2E+03 | 4.2E-04 |
| 75110_01N04A | 0.99 | 1.2 | 0.06 | 2.2E-09 | 2.2E+04 | 4.8E-05 |
| 75110_02I16A | 0.86 | 0.8 | 0.0373 | 3.90E-09 | 3.08E+05 | 1.20E-03 |
| 75110_04F22A | 0.87 | 0.8 | 0.05 | <1.0E-12 | 1.5E+04 | <1.0E-07 |
| 75110_04P06A | 0.86 | 0.8 | 0.06 | <1.0E-12 | 1.2E+04 | <1.0E-07 |
| 75110_05K11A | 0.89 | 0.8 | 0.05 | <1.0E-12 | 1.2E+04 | <1.0E-07 |
| 75110_07E04A | 0.66 | 1 | 0.01 | 1.1E-05 | 1.2E+03 | 1.3E-02 |

TABLE 19-continued

Nonclonal Supernatant Screening: Off-rate Screening

| Hybridoma ID | Full R^2 | Antibody Loading (nm, estimated) | Response | KD (M) | kon (1/Ms) | kdis (1/s) |
|---|---|---|---|---|---|---|
| 75110_08H06A | 0.82 | 0.7 | 0.06 | <1.0E−12 | 1.2E+05 | <1.0E−07 |
| 75110_08H11A | 0.85 | 1 | 0.08 | 2.9E−09 | 2.3E+05 | 6.5E−04 |
| 75110_10K21A | 0.94 | 0.8 | 0.0687 | 2.66E−09 | 1.36E+05 | 3.62E−04 |
| 75110_10N21A | 0.90 | 0.7 | 0.0658 | 8.73E−10 | 1.52E+05 | 1.33E−04 |
| 75110_13C07A | 0.77 | 0.5 | 0.0171 | 8.40E−08 | 2.17E+05 | 1.82E−02 |
| 75110_01H18A | 0.82 | 0.7 | 0.0657 | 9.02E−10 | 1.65E+05 | 1.48E−04 |
| 75110_14H13A | 0.98 | 1 | 0.14 | <1.0E−12 | 1.0E+05 | <1.0E−07 |
| 75110_06L01A | 0.99 | 1 | 0.22 | <1.0E−12 | 1.7E+05 | <1.0E−07 |
| 75110_07G23A | 0.88 | 0.9 | 0.07 | 1.4E−09 | 1.9E+05 | 2.6E−04 |
| 75110_09I11A | 0.19 | 0.9 | 0.04 | <1.0E−12 | 3.4E+05 | <1.0E−07 |
| 75110_09L24A | 0.93 | 0.8 | 0.0955 | <1.0E−12 | 1.30E+05 | <1.0E−07 |
| 75110_02L13A | 0.98 | 1 | 0.08 | 1.8E−09 | 1.5E+05 | 2.6E−04 |
| 75110_11F17A | 0.98 | 0.7 | 0.20 | 7.0E−12 | 1.9E+05 | 1.3E−04 |
| 75110_09K15A | 0.94 | 0.7 | 0.03 | <1.0E−12 | 4.8E+01 | <1.0E−07 |

TABLE 20

Clonal Purified Data: Human CD4 Octet Kinetic Characterization

| Hybridoma ID | Response | Full R^2 | KD (M) | kdis(1/s) | kon(1/Ms) |
|---|---|---|---|---|---|
| 75110_01A06A | 0.36 | 0.97 | 1.4E−08 | 1.4E−03 | 1.0E+05 |
| 75110_01A07A | 0.25 | 0.99 | 1.8E−08 | 1.2E−03 | 6.8E+04 |
| 75110_01C18A | 0.13 | 0.97 | 2.4E−08 | 4.7E−03 | 2.0E+05 |
| 75110_01D24A | 0.27 | 0.97 | 1.3E−08 | 1.7E−03 | 1.3E+05 |
| 75110_01E08A | 0.14 | 0.98 | 2.6E−10 | 2.0E−05 | 7.7E+04 |
| 75110_01G11A | 0.11 | 0.99 | 1.7E−09 | 7.2E−05 | 4.2E+04 |
| 75110_01H18A | 0.23 | 0.99 | 1.6E−08 | 1.6E−03 | 9.9E+04 |
| 75110_01J09A | 0.12 | 0.99 | 1.3E−07 | 4.8E−03 | 3.7E+04 |
| 75110_01J17A | 0.09 | 0.99 | 2.8E−10 | 1.2E−04 | 4.3E+04 |
| 75110_01K10A | 0.05 | 0.88 | <1.0E−12 | <1.0E−07 | 2.3E+04 |
| 75110_01L08A | 0.19 | 0.77 | 4.1E−09 | 1.6E−03 | 3.9E+05 |
| 75110_01N04A | 0.08 | 0.98 | 2.1E−09 | 6.1E−05 | 2.8E+04 |
| 75110_02E08A | 0.11 | 0.77 | 2.2E−09 | 6.1E−04 | 2.8E+05 |
| 75110_02E22A | 0.16 | 0.99 | 5.0E−08 | 3.1E−03 | 6.3E+04 |
| 75110_02I16A | 0.22 | 0.97 | 3.5E−09 | 4.0E−04 | 1.2E+05 |
| 75110_02I18A | 0.05 | 0.96 | 6.6E−08 | 8.6E−05 | 1.3E+03 |
| 75110_02K11A | 0.11 | 0.95 | 1.9E−08 | 1.4E−03 | 7.4E+04 |
| 75110_02N15A | 0.25 | 0.92 | 1.1E−08 | 1.7E−03 | 1.6E+05 |
| 75110_03B16A | 0.15 | 0.97 | 2.6E−08 | 3.7E−03 | 1.4E+05 |
| 75110_03C01A | 0.23 | 0.92 | 3.0E−09 | 4.0E−04 | 1.4E+05 |
| 75110_03D16A | 0.05 | 0.84 | 1.0E−08 | 8.0E−04 | 7.8E+04 |
| 75110_03I08A | 0.14 | 0.93 | 8.8E−09 | 1.1E−03 | 1.3E+05 |
| 75110_03I23A | 0.18 | 0.95 | <1.0E−12 | <1.0E−07 | 8.0E+04 |
| 75110_03L12A | 0.22 | 0.95 | 5.5E−09 | 7.6E−04 | 1.4E+05 |
| 75110_04B08A | 0.25 | 0.96 | 1.7E−08 | 3.7E−03 | 2.2E+05 |
| 75110_04D20A | 0.14 | 0.94 | 8.9E−09 | 8.0E−04 | 9.0E+04 |
| 75110_04F22A | 0.05 | 0.96 | 5.9E−09 | 2.1E−04 | 3.5E+04 |
| 75110_04G02A | 0.17 | 0.99 | 1.6E−08 | 1.5E−03 | 9.0E+04 |
| 75110_04G16A | 0.23 | 0.96 | 5.3E−09 | 4.7E−04 | 8.9E+04 |
| 75110_04H17A | 0.15 | 0.96 | 2.5E−10 | 1.8E−05 | 7.3E+04 |
| 75110_04K10A | 0.10 | 1.00 | 1.1E−07 | 4.2E−03 | 3.9E+04 |
| 75110_04P06A | 0.07 | 0.96 | <1.0E−12 | <1.0E−07 | 2.4E+04 |
| 75110_04P08A | 0.23 | 0.98 | 3.6E−09 | 5.0E−04 | 1.4E+05 |
| 75110_05A11A | 0.27 | 0.98 | 1.8E−08 | 1.8E−03 | 9.7E+04 |
| 75110_05B13A | 0.28 | 0.96 | 5.4E−09 | 5.8E−04 | 1.1E+05 |
| 75110_05E05A | 0.18 | 0.98 | <1.0E−12 | <1.0E−07 | 3.4E+04 |
| 75110_05E13A | 0.37 | 0.97 | 2.2E−09 | 2.2E−04 | 1.0E+05 |
| 75110_05F19A | 0.05 | 0.94 | <1.0E−12 | <1.0E−07 | 1.9E+04 |
| 75110_05G15A | 0.09 | 0.91 | 1.3E−08 | 2.2E−03 | 1.7E+05 |
| 75110_05K11A | 0.04 | 0.94 | <1.0E−12 | <1.0E−07 | 3.6E+04 |
| 75110_05L07A | 0.28 | 1.00 | 1.5E−08 | 1.6E−03 | 1.1E+05 |
| 75110_06C16A | 0.15 | 0.96 | 1.6E−08 | 1.2E−03 | 7.5E+04 |
| 75110_06D16A | 0.25 | 0.98 | 2.8E−09 | 2.8E−04 | 1.0E+05 |
| 75110_06E14A | 0.11 | 0.97 | 1.4E−08 | 2.6E−04 | 1.8E+04 |
| 75110_06G04A | 0.07 | 0.83 | 6.0E−09 | 1.5E−03 | 2.5E+05 |
| 75110_06K03A | 0.11 | 0.97 | 2.2E−09 | 3.6E−05 | 1.6E+04 |
| 75110_07B16A | 0.24 | 0.93 | 3.0E−09 | 4.3E−04 | 1.4E+05 |
| 75110_07E04A | 0.07 | 0.97 | <1.0E−12 | <1.0E−07 | 3.5E+04 |
| 75110_07H07A | 0.16 | 0.89 | 9.4E−09 | 1.2E−03 | 1.3E+05 |
| 75110_07J02A | 0.10 | 0.92 | 1.4E−08 | 2.2E−03 | 1.6E+05 |
| 75110_07J24A | 0.19 | 0.96 | 7.1E−09 | 6.0E−04 | 8.5E+04 |
| 75110_07N04A | 0.20 | 0.96 | <1.0E−12 | <1.0E−07 | 8.4E+04 |
| 75110_08A13A | 0.12 | 0.94 | 6.6E−09 | 7.8E−04 | 1.2E+05 |
| 75110_08D24A | 0.11 | 0.97 | 2.2E−08 | 2.7E−04 | 1.2E+04 |
| 75110_08F20A | 0.22 | 0.99 | 8.4E−09 | 1.4E−03 | 1.7E+05 |
| 75110_08G08A | 0.15 | 0.99 | 2.0E−08 | 3.5E−03 | 1.8E+05 |
| 75110_08H06A | 0.04 | 0.97 | 1.1E−08 | 4.3E−04 | 3.9E+04 |
| 75110_08H11A | 0.04 | 0.95 | 2.6E−08 | 3.6E−05 | 1.4E+03 |
| 75110_08K12A | 0.05 | 0.98 | 2.2E−07 | 2.2E−04 | 1.0E+03 |
| 75110_08M20A | 0.16 | 0.99 | 9.2E−09 | 9.1E−04 | 9.9E+04 |
| 75110_09G15A | 0.21 | 0.99 | 4.8E−09 | 4.0E−03 | 8.5E+04 |
| 75110_09N20A | 0.09 | 0.96 | 5.3E−08 | 4.5E−03 | 8.6E+04 |
| 75110_10K21A | 0.20 | 0.98 | 3.1E−09 | 4.9E−04 | 1.6E+05 |
| 75110_10L22A | 0.03 | 0.64 | 1.2E−08 | 4.5E−04 | 3.7E+04 |
| 75110_10N21A | 0.09 | 0.98 | 5.9E−10 | 3.2E−05 | 5.5E+04 |
| 75110_10O16A | 0.08 | 0.91 | 2.4E−09 | 3.5E−04 | 1.4E+05 |
| 75110_11D03A | 0.09 | 0.68 | 3.2E−09 | 1.3E−03 | 4.2E+05 |
| 75110_12C19A | 0.08 | 0.81 | 5.0E−09 | 1.5E−03 | 2.9E+05 |
| 75110_12H17A | 0.19 | 0.96 | 2.6E−08 | 3.3E−03 | 1.2E+05 |
| 75110_12H19A | 0.25 | 0.95 | 1.3E−08 | 2.2E−03 | 1.7E+05 |
| 75110_12K21A | 0.22 | 0.97 | 1.8E−09 | 2.1E−04 | 1.1E+05 |
| 75110_13C07A | 0.11 | 0.97 | 1.7E−09 | 1.6E−04 | 9.2E+04 |
| 75110_13C13A | 0.21 | 0.96 | 1.1E−08 | 1.3E−03 | 1.2E+05 |
| 75110_13P21A | 0.17 | 0.95 | 3.0E−09 | 2.9E−04 | 9.5E+04 |
| 75110_13P22A | 0.16 | 0.97 | 1.4E−08 | 1.2E−03 | 8.6E+04 |
| 75110_14G10A | 0.19 | 0.88 | 3.8E−10 | 1.9E−04 | 5.0E+05 |
| 75110_14H13A | 0.08 | 0.99 | 2.1E−09 | 1.1E−04 | 5.4E+04 |
| 75110_14I16A | 0.14 | 0.98 | 1.0E−08 | 1.7E−03 | 1.6E+05 |
| 75110_14N19A | 0.17 | 0.99 | 1.1E−08 | 1.4E−03 | 1.3E+05 |
| 75110_14P05A | 0.05 | 0.91 | <1.0E−12 | <1.0E−07 | 9.5E+04 |
| 75110_14P08A | 0.17 | 0.99 | 3.3E−10 | 3.2E−05 | 9.6E+04 |

TABLE 21

Clonal Purified Data: Rhesus CD4 Octet Kinetic Characterization

| Hybridoma ID | Response | Full R^2 | KD (M) | kdis (1/s) | kon (1/Ms) |
|---|---|---|---|---|---|
| 75110_01A06A | 0.39 | 0.95 | 7.8E−09 | 1.0E−03 | 1.3E+05 |
| 75110_01A07A | 0.26 | 0.99 | 2.6E−08 | 1.9E−03 | 7.2E+04 |
| 75110_01C18A | NB | NB | NB | NB | NB |
| 75110_01D24A | 0.08 | 0.97 | 3.4E−07 | 6.4E−02 | 1.9E+05 |
| 75110_01E08A | 0.10 | 0.92 | 9.8E−10 | 1.4E−04 | 1.4E+05 |
| 75110_01G11A | 0.03 | 0.90 | 6.4E−08 | 1.8E−03 | 2.8E+04 |
| 75110_01H18A | 0.11 | 0.99 | 1.3E−07 | 1.7E−02 | 1.3E+05 |
| 75110_01J09A | 0.17 | 0.98 | 7.0E−08 | 3.2E−03 | 4.6E+04 |
| 75110_01J17A | 0.05 | 0.91 | 2.2E−08 | 1.7E−03 | 7.9E+04 |

TABLE 21-continued

Clonal Purified Data: Rhesus CD4 Octet Kinetic Characterization

| Hybridoma ID | Response | Full R^2 | KD (M) | kdis (1/s) | kon (1/Ms) |
|---|---|---|---|---|---|
| 75110_01K10A | NB | NB | NB | NB | NB |
| 75110_01L08A | 0.06 | 0.92 | 8.1E−09 | 1.1E−03 | 1.4E+05 |
| 75110_01N04A | 0.02 | 0.78 | 3.5E−11 | 6.1E−03 | 1.7E+08 |
| 75110_02E08A | 0.04 | 0.77 | 1.2E−08 | 9.1E−04 | 7.9E+04 |
| 75110_02E22A | 0.15 | 0.99 | 5.1E−08 | 4.4E−03 | 8.7E+04 |
| 75110_02I16A | 0.14 | 0.97 | 3.7E−08 | 9.2E−03 | 2.5E+05 |
| 75110_02I18A | NB | NB | NB | NB | NB |
| 75110_02K11A | 0.13 | 0.97 | 2.6E−08 | 1.5E−03 | 5.9E+04 |
| 75110_02N15A | 0.29 | 0.96 | 1.4E−08 | 2.6E−03 | 1.9E+05 |
| 75110_03B16A | 0.19 | 0.98 | 2.3E−08 | 4.0E−03 | 1.7E+05 |
| 75110_03C01A | 0.18 | 0.88 | 9.8E−09 | 2.7E−03 | 2.8E+05 |
| 75110_03D16A | 0.10 | 0.91 | 1.2E−08 | 2.0E−03 | 1.6E+05 |
| 75110_03I08A | 0.04 | 0.85 | 6.1E−09 | 6.1E−04 | 1.0E+05 |
| 75110_03I23A | NB | NB | NB | NB | NB |
| 75110_03L12A | 0.08 | 0.98 | 7.2E−08 | 1.6E−02 | 2.2E+05 |
| 75110_04B08A | 0.26 | 0.97 | 1.8E−08 | 4.8E−03 | 2.7E+05 |
| 75110_04D20A | 0.13 | 0.97 | 1.2E−08 | 1.7E−03 | 1.4E+05 |
| 75110_04F22A | 0.04 | 0.86 | 7.2E−09 | 1.1E−03 | 1.5E+05 |
| 75110_04G02A | NB | NB | NB | NB | NB |
| 75110_04G16A | 0.27 | 0.98 | 2.4E−08 | 2.2E−04 | 9.2E+04 |
| 75110_04H17A | 0.18 | 0.97 | 1.7E−09 | 2.0E−04 | 1.2E+05 |
| 75110_04K10A | 0.17 | 0.99 | 4.8E−08 | 3.2E−03 | 6.7E+04 |
| 75110_04P06A | NB | NB | NB | NB | NB |
| 75110_04P08A | 0.12 | 0.99 | 6.0E−08 | 9.1E−03 | 1.5E+05 |
| 75110_05A11A | NB | NB | NB | NB | NB |
| 75110_05B13A | 0.14 | 0.80 | 4.7E−09 | 2.0E−03 | 4.2E+05 |
| 75110_05E05A | 0.06 | 0.92 | 2.3E−09 | 4.9E−05 | 2.1E+04 |
| 75110_05E13A | 0.03 | 0.81 | 6.7E−09 | 7.9E−03 | 1.2E+06 |
| 75110_05F19A | NB | NB | NB | NB | NB |
| 75110_05G15A | NB | NB | NB | NB | NB |
| 75110_05K11A | 0.01 | 0.46 | 7.8E−09 | 1.1E−03 | 1.4E+05 |
| 75110_05L07A | 0.31 | 1.00 | 7.6E−09 | 1.1E−03 | 1.5E+05 |
| 75110_06C16A | 0.15 | 0.97 | 2.7E−08 | 2.0E−03 | 7.3E+04 |
| 75110_06D16A | 0.09 | 0.93 | 2.4E−07 | 2.2E−02 | 9.1E+04 |
| 75110_06E14A | 0.10 | 0.96 | 2.3E−07 | 6.9E−04 | 3.0E+03 |
| 75110_06G04A | 0.05 | 0.69 | 2.1E−09 | 1.1E−03 | 5.1E+05 |
| 75110_06K03A | 0.13 | 0.97 | 7.8E−09 | 3.5E−04 | 4.5E+04 |
| 75110_07B16A | 0.17 | 0.92 | 1.3E−08 | 3.3E−03 | 2.5E+05 |
| 75110_07E04A | 0.02 | 0.78 | 2.6E−09 | 4.2E−04 | 1.6E+05 |
| 75110_07H07A | 0.15 | 0.98 | 3.2E−08 | 3.0E−03 | 9.4E+04 |
| 75110_07J02A | 0.14 | 0.95 | 1.8E−08 | 2.8E−03 | 1.5E+05 |
| 75110_07J24A | NB | NB | NB | NB | NB |
| 75110_07N04A | 0.03 | 0.83 | <1.0E−12 | <1.0E−07 | 1.3E+04 |
| 75110_08A13A | 0.15 | 0.96 | 5.1E−09 | 9.8E−04 | 1.9E+05 |
| 75110_08D24A | 0.05 | 0.75 | 5.3E−08 | 1.7E−03 | 3.2E+04 |
| 75110_08F20A | 0.22 | 0.98 | 1.1E−08 | 2.6E−03 | 2.3E+05 |
| 75110_08G08A | 0.15 | 0.96 | 1.9E−08 | 4.1E−03 | 2.2E+05 |
| 75110_08H06A | NB | NB | NB | NB | NB |
| 75110_08H11A | NB | NB | NB | NB | NB |
| 75110_08K12A | 0.01 | 0.63 | 9.4E−08 | 5.3E−03 | 5.7E+04 |
| 75110_08M20A | 0.17 | 0.99 | 1.7E−08 | 2.2E−03 | 1.3E+05 |
| 75110_09G15A | 0.27 | 0.99 | 3.6E−08 | 3.0E−03 | 8.4E+04 |
| 75110_09N20A | 0.14 | 0.99 | 4.4E−08 | 4.0E−03 | 9.2E+04 |
| 75110_10K21A | 0.23 | 0.99 | 2.1E−09 | 3.3E−04 | 1.6E+05 |
| 75110_10L22A | 0.02 | 0.54 | 5.5E−09 | 7.5E−04 | 1.4E+05 |
| 75110_10N21A | 0.07 | 0.88 | 8.2E−09 | 1.0E−03 | 1.3E+05 |
| 75110_10O16A | 0.04 | 0.85 | 3.1E−09 | 7.5E−04 | 2.4E+05 |
| 75110_11D03A | 0.11 | 0.73 | 3.5E−09 | 1.8E−03 | 5.3E+05 |
| 75110_12C19A | 0.10 | 0.90 | 1.6E−08 | 3.8E−03 | 2.4E+05 |
| 75110_12H17A | 0.23 | 0.97 | 2.2E−08 | 3.2E−03 | 1.5E+05 |
| 75110_12H19A | 0.28 | 0.97 | 1.4E−08 | 2.6E−03 | 1.9E+05 |
| 75110_12K21A | 0.16 | 0.94 | 2.1E−08 | 5.6E−03 | 2.7E+05 |
| 75110_13C07A | 0.05 | 0.79 | 3.9E−09 | 8.5E−04 | 2.2E+05 |
| 75110_13C13A | 0.09 | 0.79 | 8.3E−09 | 4.6E−03 | 5.5E+05 |
| 75110_13P21A | 0.11 | 0.99 | 7.5E−08 | 1.3E−02 | 1.7E+05 |
| 75110_13P22A | 0.01 | 0.60 | 8.8E−07 | 7.2E−02 | 8.1E+04 |
| 75110_14G10A | NB | NB | NB | NB | NB |
| 75110_14H13A | NB | NB | NB | NB | NB |
| 75110_14I16A | 0.13 | 0.98 | 1.4E−08 | 2.7E−03 | 1.9E+05 |
| 75110_14N19A | 0.17 | 0.99 | 1.4E−08 | 2.1E−03 | 1.5E+05 |
| 75110_14P05A | 0.02 | 0.69 | <1.0E−12 | <1.0E−07 | 9.3E+04 |
| 75110_14P08A | 0.06 | 0.94 | 8.8E−09 | 6.6E−04 | 7.5E+04 |

TABLE 22

Clonal Supernatant PBMC Binding & Purification Data Summary

| | Clonal Supernatant PBMC FACS Binding Data | | Purification Data Summary | | | | | |
|---|---|---|---|---|---|---|---|---|
| Hybridoma ID | % CD4 Stain | gMFI of CD4+ | Lot No. | Conc. (mg/ml) | Vol. (mg/ml) | Amt. (µg) | % HMW | % Main | % LMW |
| 75110_01A06A | 33.7 | 115075 | 200716 | 3.55 | 0.41 | 1455 | 0.71 | 98.00 | 1.29 |
| 75110_01A07A | 33.2 | 310941 | 200717 | 4.07 | 0.22 | 908 | 1.00 | 96.70 | 2.30 |
| 75110_01C18A | 34.1 | 204727 | 200717 | 3.59 | 0.19 | 696 | 0.87 | 92.75 | 6.38 |
| 75110_01D24A | 32.9 | 133815 | 200716 | 3.58 | 0.49 | 1759 | 1.78 | 96.86 | 1.36 |
| 75110_01E08A | 36.5 | 112651 | 200716 | 3.66 | 0.24 | 883 | 2.96 | 95.00 | 2.05 |
| 75110_01G11A | 39.0 | 164166 | 200716 | 3.48 | 0.22 | 779 | 1.70 | 96.04 | 2.26 |
| 75110_01H18A | 48.8 | 100911 | 200716 | 3.95 | 0.34 | 1359 | 3.18 | 95.21 | 1.61 |
| 75110_01J09A | 34.8 | 142980 | 200716 | 2.77 | 0.29 | 805 | 6.22 | 92.73 | 1.05 |
| 75110_01J17A | 35.2 | 166740 | 200716 | 3.70 | 0.25 | 922 | 1.74 | 97.03 | 1.23 |
| 75110_01K10A | 38.0 | 191431 | 200716 | 3.38 | 0.39 | 1299 | 1.43 | 97.01 | 1.56 |
| 75110_01L08A | 35.3 | 208062 | 200716 | 3.91 | 0.27 | 1068 | 1.61 | 96.39 | 2.01 |
| 75110_01N04A | 37.2 | 205484 | 200716 | 3.71 | 0.15 | 572 | 3.19 | 94.45 | 2.35 |
| 75110_02E08A | 35.4 | 114945 | 200716 | 3.47 | 0.30 | 1026 | 7.05 | 92.76 | 0.19 |
| 75110_02E22A | 32.8 | 268136 | 200717 | 2.36 | 0.14 | 337 | 1.74 | 94.75 | 3.51 |
| 75110_02I16A | 36.1 | 144966 | 200716 | 3.16 | 0.45 | 1423 | 1.39 | 97.91 | 0.70 |
| 75110_02I18A | 40.5 | 161770 | 200716 | 1.09 | 0.16 | 178 | 2.65 | 88.33 | 9.02 |
| 75110_02K11A | 28.2 | 202868 | 200717 | 1.91 | 0.20 | 388 | 7.28 | 89.65 | 3.07 |
| 75110_02N15A | 39.0 | 252617 | 200716 | 3.88 | 0.35 | 1367 | 1.35 | 97.57 | 1.08 |
| 75110_03B16A | 34.2 | 90652 | 200716 | 2.18 | 0.19 | 417 | 3.37 | 85.18 | 11.45 |
| 75110_03C01A | 36.1 | 169050 | 200716 | 2.93 | 0.18 | 522 | 4.92 | 90.63 | 4.45 |
| 75110_03D16A | 35.6 | 206658 | 200717 | 3.57 | 0.40 | 1411 | 1.63 | 96.15 | 2.22 |
| 75110_03I08A | 17.8 | 26145 | 200716 | 3.59 | 0.33 | 1166 | 1.45 | 97.05 | 1.50 |
| 75110_03I23A | 26.2 | 67899 | 200717 | 1.15 | 0.15 | 168 | 1.33 | 95.59 | 3.08 |
| 75110_03L12A | 36.8 | 162348 | 200716 | 4.01 | 0.41 | 1636 | 1.51 | 96.93 | 1.56 |
| 75110_04B08A | 40.6 | 245613 | 200716 | 3.62 | 0.32 | 1139 | 0.98 | 97.50 | 1.52 |

TABLE 22-continued

Clonal Supernatant PBMC Binding & Purification Data Summary

| | Clonal Supernatant PBMC FACS Binding Data | | Purfication Data Summary | | | | | | |
|---|---|---|---|---|---|---|---|---|---|
| Hybridoma ID | % CD4 Stain | gMFI of CD4+ | Lot No. | Conc. (mg/ml) | Vol. (mg/ml) | Amt. (μg) | % HMW | % Main | % LMW |
| 75110_04D20A | 33.2 | 241176 | 200717 | 2.83 | 0.37 | 1044 | 0.89 | 97.20 | 1.91 |
| 75110_04F22A | 37.7 | 215983 | 200716 | 1.92 | 0.35 | 677 | 1.73 | 96.62 | 1.65 |
| 75110_04G02A | 38.5 | 187393 | 200716 | 3.82 | 0.32 | 1236 | 3.61 | 94.30 | 2.10 |
| 75110_04G16A | 36.3 | 240496 | 200716 | 3.59 | 0.24 | 864 | 1.46 | 92.63 | 5.91 |
| 75110_04H17A | 28.8 | 151001 | 200717 | 4.06 | 0.37 | 1508 | 1.51 | 96.25 | 2.24 |
| 75110_04K10A | 35.6 | 148953 | 200716 | 4.02 | 0.37 | 1493 | 2.28 | 97.02 | 0.70 |
| 75110_04P06A | 36.9 | 240938 | 200716 | 3.96 | 0.19 | 736 | 1.83 | 95.73 | 2.44 |
| 75110_04P08A | 36.4 | 127885 | 200721 | 2.93 | 0.44 | 1278 | 1.92 | 96.00 | 2.08 |
| 75110_05A11A | 35.9 | 245571 | 200716 | 3.68 | 0.36 | 1320 | 0.06 | 99.09 | 0.85 |
| 75110_05B13A | 55.8 | 135097 | 200716 | 3.01 | 0.51 | 1544 | 0.52 | 97.40 | 2.08 |
| 75110_05E05A | 31.8 | 63987 | 200717 | 3.74 | 0.27 | 995 | 2.02 | 94.17 | 3.80 |
| 75110_05E13A | 38.9 | 257219 | 200716 | 1.37 | 0.18 | 241 | ND | 86.35 | 13.65 |
| 75110_05F19A | 37.1 | 155080 | 200716 | 2.15 | 0.19 | 399 | 1.08 | 96.26 | 2.66 |
| 75110_05G15A | 31.6 | 325704 | 200717 | 3.25 | 0.29 | 931 | 1.54 | 94.27 | 4.20 |
| 75110_05K11A | 38.1 | 111774 | 200716 | 1.99 | 0.31 | 620 | 3.40 | 92.79 | 3.82 |
| 75110_05L07A | 37.9 | 156079 | 200716 | 3.80 | 0.43 | 1633 | 2.75 | 96.01 | 1.24 |
| 75110_06C16A | 33.1 | 269944 | 200717 | 3.57 | 0.61 | 2194 | 1.33 | 96.94 | 1.72 |
| 75110_06D16A | 39.2 | 253142 | 200721 | 1.66 | 0.10 | 161 | 0.82 | 95.63 | 3.55 |
| 75110_06E14A | 31.7 | 224610 | 200717 | 3.85 | 0.31 | 1174 | 1.11 | 96.96 | 1.93 |
| 75110_06G04A | 34.8 | 306560 | 200717 | 3.6 | 0.38 | 1368 | 0.66 | 99.34 | ND |
| 75110_06K03A | 34.0 | 320202 | 200717 | 3.38 | 0.38 | 1279 | 10.02 | 88.03 | 1.94 |
| 75110_07B16A | 37.3 | 189030 | 200716 | 1.12 | 0.19 | 214 | 2.77 | 95.19 | 2.04 |
| 75110_07E04A | 36.1 | 141485 | 200716 | 1.30 | 0.30 | 386 | 2.62 | 93.97 | 3.41 |
| 75110_07H07A | 37.1 | 204048 | 200716 | 3.77 | 0.32 | 1186 | 1.50 | 96.88 | 1.61 |
| 75110_07J02A | 33.4 | 227689 | 200721 | 3.37 | 0.17 | 559 | 1.79 | 93.19 | 5.02 |
| 75110_07J24A | 28.8 | 28372 | 200716 | 3.83 | 0.25 | 965 | 2.24 | 95.66 | 2.10 |
| 75110_07N04A | 33.8 | 104160 | 200721 | 3.85 | 0.25 | 971 | 0.85 | 96.06 | 3.09 |
| 75110_08A13A | 30.3 | 140031 | 200721 | 3.48 | 0.21 | 712 | 1.43 | 96.54 | 2.03 |
| 75110_08D24A | 33.6 | 331704 | 200721 | 3.46 | 0.26 | 910 | 1.49 | 97.70 | 0.81 |
| 75110_08F20A | 33.2 | 306832 | 200721 | 4.11 | 0.36 | 1462 | 3.26 | 95.34 | 1.40 |
| 75110_08G08A | 32.2 | 324052 | 200721 | 3.61 | 0.40 | 1455 | 3.56 | 94.37 | 2.08 |
| 75110_08H06A | 28.1 | 88823 | 200721 | 3.6 | 0.17 | 620 | 2.67 | 93.67 | 3.66 |
| 75110_08H11A | 27.1 | 87025 | 200721 | 3.02 | 0.10 | 302 | 5.92 | 87.13 | 6.96 |
| 75110_08K12A | 34.6 | 174702 | 200721 | 3.66 | 0.14 | 505 | 1.09 | 95.01 | 3.90 |
| 75110_08M20A | 34.1 | 343164 | 200721 | 3.81 | 0.34 | 1285 | 2.13 | 96.06 | 1.81 |
| 75110_09G15A | 37.3 | 236716 | 200716 | 3.96 | 0.36 | 1427 | 2.71 | 95.18 | 2.11 |
| 75110_09N20A | 37.5 | 227238 | 200716 | 3.71 | 0.57 | 2123 | 1.47 | 97.12 | 1.41 |
| 75110_10K21A | 29.0 | 118644 | 200721 | 4.06 | 0.32 | 1314 | 3.32 | 93.19 | 3.49 |
| 75110_10L22A | 34.3 | 77406 | 200721 | 3.67 | 0.12 | 456 | 3.97 | 93.48 | 2.56 |
| 75110_10N21A | 38.3 | 202650 | 200716 | 1.54 | 0.22 | 334 | 1.61 | 95.02 | 3.37 |
| 75110_10O16A | 37.2 | 133087 | 200721 | 3.58 | 0.16 | 580 | 2.43 | 93.51 | 4.05 |
| 75110_11D03A | 30.1 | 217408 | 200721 | 3.82 | 0.17 | 653 | 1.29 | 96.06 | 1.83 |
| 75110_12C19A | 24.4 | 56480 | 200721 | 3.67 | 0.31 | 1128 | 2.10 | 95.09 | 2.80 |
| 75110_12H17A | 37.3 | 196996 | 200716 | 3.78 | 0.33 | 1258 | 2.04 | 96.54 | 1.42 |
| 75110_12H19A | 36.8 | 284458 | 200716 | 3.98 | 0.31 | 1237 | 2.78 | 95.83 | 1.38 |
| 75110_12K21A | 37.2 | 146837 | 200716 | 3.34 | 0.45 | 1504 | 2.00 | 96.24 | 1.77 |
| 75110_13C07A | 37.5 | 55986 | 200716 | 3.29 | 0.24 | 785 | 1.67 | 96.82 | 1.51 |
| 75110_13C13A | 28.6 | 123167 | 200716 | 3.98 | 0.56 | 2241 | 2.82 | 95.99 | 1.19 |
| 75110_13P21A | 27.2 | 31810 | 200716 | 3.51 | 0.21 | 745 | 3.37 | 93.04 | 3.59 |
| 75110_13P22A | 37.5 | 184686 | 200717 | 3.88 | 0.28 | 1067 | 2.49 | 95.34 | 2.17 |
| 75110_14G10A | 31.1 | 240647 | 200721 | 3.39 | 0.29 | 987 | 1.55 | 96.00 | 2.45 |
| 75110_14H13A | 35.3 | 160296 | 200721 | 3.94 | 0.32 | 1260 | 0.61 | 96.84 | 2.56 |
| 75110_14I16A | 33.2 | 297915 | 200721 | 4.02 | 0.20 | 787 | 0.69 | 97.20 | 2.10 |
| 75110_14N19A | 32.5 | 264556 | 200721 | 3.81 | 0.12 | 450 | 2.62 | 93.98 | 3.40 |
| 75110_14P05A | 28.6 | 93542 | 200721 | 1.47 | 0.23 | 337 | 2.24 | 94.64 | 3.12 |
| 75110_14P08A | 28.3 | 58528 | 200721 | 3.18 | 0.38 | 1209 | 0.27 | 97.01 | 2.72 |

It will be appreciated by those skilled in the art that changes could be made to the embodiments described above without departing from the broad inventive concept thereof. It is understood, therefore, that this invention is not limited to the particular embodiments disclosed, but it is intended to cover modifications within the spirit and scope of the present invention as defined by the present description.

SEQUENCE LISTING (4969 sequences)

SEQ ID NO: 1 - protein, 5 aa, Artificial Sequence
  Description of Artificial Sequence: Synthetic peptide
DYYMN

SEQ ID NO: 2 - protein, 17 aa, Artificial Sequence
  Description of Artificial Sequence: Synthetic peptide
RVIPSNGGTIYNLKFKG

SEQ ID NO: 3 - protein, 15 aa, Artificial Sequence
  Description of Artificial Sequence: Synthetic peptide
EDYNNQGFFLDAMDY

SEQ ID NO: 4 - protein, 11 aa, Artificial Sequence
  Description of Artificial Sequence: Synthetic peptide
RASQSISDFLH

SEQ ID NO: 5 - protein, 7 aa, Artificial Sequence
  Description of Artificial Sequence: Synthetic peptide
YASQSIS

SEQ ID NO: 6 - protein, 9 aa, Artificial Sequence
  Description of Artificial Sequence: Synthetic peptide
QNGHSFPYT

SEQ ID NO: 7 - protein, 7 aa, Artificial Sequence
  Description of Artificial Sequence: Synthetic peptide
GYTFTDY

SEQ ID NO: 8 - protein, 6 aa, Artificial Sequence
  Description of Artificial Sequence: Synthetic peptide
IPSNGG

SEQ ID NO: 9 - protein, 14 aa, Artificial Sequence
  Description of Artificial Sequence: Synthetic peptide
EDYNNQGFFLDAMD

SEQ ID NO: 10 - protein, 7 aa, Artificial Sequence
  Description of Artificial Sequence: Synthetic peptide
SQSISDF

SEQ ID NO: 11 - protein, 3 aa, Artificial Sequence
  Description of Artificial Sequence: Synthetic peptide
YAS

SEQ ID NO: 12 - protein, 6 aa, Artificial Sequence
  Description of Artificial Sequence: Synthetic peptide
GHSFPY

SEQ ID NO: 13 - protein, 10 aa, Artificial Sequence
  Description of Artificial Sequence: Synthetic peptide
GYTFTDYYMN

SEQ ID NO: 14 - protein, 10 aa, Artificial Sequence
  Description of Artificial Sequence: Synthetic peptide
RVIPSNGGTI

SEQ ID NO: 15 - protein, 15 aa, Artificial Sequence
  Description of Artificial Sequence: Synthetic peptide
EDYNNQGFFLDAMDY

SEQ ID NO: 16 - protein, 11 aa, Artificial Sequence
  Description of Artificial Sequence: Synthetic peptide
RASQSISDFLH

SEQ ID NO: 17 - protein, 7 aa, Artificial Sequence
  Description of Artificial Sequence: Synthetic peptide
YASQSIS

SEQ ID NO: 18 - protein, 9 aa, Artificial Sequence
  Description of Artificial Sequence: Synthetic peptide
QNGHSFPYT

SEQ ID NO: 19 - protein, 6 aa, Artificial Sequence
  Description of Artificial Sequence: Synthetic peptide
TDYYMN

SEQ ID NO: 20 - protein, 13 aa, Artificial Sequence
  Description of Artificial Sequence: Synthetic peptide
WIGRVIPSNGGTI

SEQ ID NO: 21 - protein, 16 aa, Artificial Sequence
  Description of Artificial Sequence: Synthetic peptide
AREDYNNQGFFLDAMD

SEQ ID NO: 22 - protein, 7 aa, Artificial Sequence
  Description of Artificial Sequence: Synthetic peptide
SDFLHWY

SEQ ID NO: 23 - protein, 10 aa, Artificial Sequence
  Description of Artificial Sequence: Synthetic peptide
LLIKYASQSI

SEQ ID NO: 24 - protein, 8 aa, Artificial Sequence
  Description of Artificial Sequence: Synthetic peptide
QNGHSFPY

SEQ ID NO: 25 - protein, 8 aa, Artificial Sequence
  Description of Artificial Sequence: Synthetic peptide
GYTFTDYY

SEQ ID NO: 26 - protein, 8 aa, Artificial Sequence
  Description of Artificial Sequence: Synthetic peptide
VIPSNGGT

SEQ ID NO: 27 - protein, 17 aa, Artificial Sequence
  Description of Artificial Sequence: Synthetic peptide
AREDYNNQGFFLDAMDY

SEQ ID NO: 28 - protein, 6 aa, Artificial Sequence
  Description of Artificial Sequence: Synthetic peptide
QSISDF

SEQ ID NO: 29 - protein, 3 aa, Artificial Sequence
  Description of Artificial Sequence: Synthetic peptide
YAS

SEQ ID NO: 30 - protein, 9 aa, Artificial Sequence
  Description of Artificial Sequence: Synthetic peptide
QNGHSFPYT

SEQ ID NO: 31 - protein, 124 aa, Artificial Sequence
  Description of Artificial Sequence: Synthetic polypeptide
QIQLVQSGPELVKPGTSMKMSCKASGYTFTDYYMNWVKQSHGKSLEWIGRVIPSNGGTIYNLKFKGKATLTVDKSLSTAYMQLNSLTSEDSAVYFCAREDYNNQGFFLDAMDYWGQGTSVTVSS

SEQ ID NO: 32 - protein, 107 aa, Artificial Sequence
  Description of Artificial Sequence: Synthetic polypeptide
DIVLTQSPATLSVTPGDRVSLSCRASQSISDFLHWYQQKSHESPRLLIKYASQSISGIPSRFSGSGSGSDFTLTINSVEPEDVGVYYCQNGHSFPYTFGSGTKLEIK

SEQ ID NO: 33 - protein, 454 aa, Artificial Sequence
  Description of Artificial Sequence: Synthetic polypeptide
QIQLVQSGPELVKPGTSMKMSCKASGYTFTDYYMNWVKQSHGKSLEWIGRVIPSNGGTIYNLKFKGKATLTVDKSLSTAYMQLNSLTSEDSAVYFCAREDYNNQGFFLDAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 34 - protein, 214 aa, Artificial Sequence
  Description of Artificial Sequence: Synthetic polypeptide
DIVLTQSPATLSVTPGDRVSLSCRASQSISDFLHWYQQKSHESPRLLIKYASQSISGIPSRFSGSGSGSDFTLTINSVEPEDVGVYYCQNGHSFPYTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 35 - protein, 5 aa, Artificial Sequence
  Description of Artificial Sequence: Synthetic peptide
DYYMN

SEQ ID NO: 36 - protein, 17 aa, Artificial Sequence
  Description of Artificial Sequence: Synthetic peptide
RIIPSNGATIYNQKFKG

SEQ ID NO: 37 - protein, 15 aa, Artificial Sequence
  Description of Artificial Sequence: Synthetic peptide
EDYSNQGFFLDAMDY

SEQ ID NO: 38 - protein, 11 aa, Artificial Sequence
  Description of Artificial Sequence: Synthetic peptide
RASQSISHYLH

SEQ ID NO: 39 - protein, 7 aa, Artificial Sequence
  Description of Artificial Sequence: Synthetic peptide
YASQSIS

SEQ ID NO: 40 - protein, 9 aa, Artificial Sequence
  Description of Artificial Sequence: Synthetic peptide
QNGHSFPYT

SEQ ID NO: 41 - protein, 7 aa, Artificial Sequence
  Description of Artificial Sequence: Synthetic peptide
GYTFTDY

SEQ ID NO: 42 - protein, 6 aa, Artificial Sequence
  Description of Artificial Sequence: Synthetic peptide
IPSNGA

SEQ ID NO: 43 - protein, 14 aa, Artificial Sequence
  Description of Artificial Sequence: Synthetic peptide
EDYSNQGFFLDAMD

SEQ ID NO: 44 - protein, 7 aa, Artificial Sequence
  Description of Artificial Sequence: Synthetic peptide
SQSISHY

SEQ ID NO: 45 - protein, 3 aa, Artificial Sequence
  Description of Artificial Sequence: Synthetic peptide
YAS

SEQ ID NO: 46 - protein, 6 aa, Artificial Sequence
  Description of Artificial Sequence: Synthetic peptide
GHSFPY

SEQ ID NO: 47 - protein, 10 aa, Artificial Sequence
  Description of Artificial Sequence: Synthetic peptide
GYTFTDYYMN

SEQ ID NO: 48 - protein, 10 aa, Artificial Sequence
  Description of Artificial Sequence: Synthetic peptide
RIIPSNGATI

SEQ ID NO: 49 - protein, 15 aa, Artificial Sequence
  Description of Artificial Sequence: Synthetic peptide
EDYSNQGFFLDAMDY

SEQ ID NO: 50 - protein, 11 aa, Artificial Sequence
  Description of Artificial Sequence: Synthetic peptide
RASQSISHYLH

SEQ ID NO: 51 - protein, 7 aa, Artificial Sequence
  Description of Artificial Sequence: Synthetic peptide
YASQSIS

SEQ ID NO: 52 - protein, 9 aa, Artificial Sequence
  Description of Artificial Sequence: Synthetic peptide
QNGHSFPYT

SEQ ID NO: 53 - protein, 6 aa, Artificial Sequence
  Description of Artificial Sequence: Synthetic peptide
TDYYMN

SEQ ID NO: 54 - protein, 13 aa, Artificial Sequence
  Description of Artificial Sequence: Synthetic peptide
WIGRIIPSNGATI

SEQ ID NO: 55 - protein, 16 aa, Artificial Sequence
  Description of Artificial Sequence: Synthetic peptide
AREDYSNQGFFLDAMD

SEQ ID NO: 56 - protein, 7 aa, Artificial Sequence
  Description of Artificial Sequence: Synthetic peptide
SHYLHWY

SEQ ID NO: 57 - protein, 10 aa, Artificial Sequence
  Description of Artificial Sequence: Synthetic peptide
LLIKYASQSI

SEQ ID NO: 58 - protein, 8 aa, Artificial Sequence
  Description of Artificial Sequence: Synthetic peptide
QNGHSFPY

SEQ ID NO: 59 - protein, 8 aa, Artificial Sequence
  Description of Artificial Sequence: Synthetic peptide
GYTFTDYY

SEQ ID NO: 60 - protein, 8 aa, Artificial Sequence
  Description of Artificial Sequence: Synthetic peptide
IIPSNGAT

SEQ ID NO: 61 - protein, 17 aa, Artificial Sequence
  Description of Artificial Sequence: Synthetic peptide
AREDYSNQGFFLDAMDY

SEQ ID NO: 62 - protein, 6 aa, Artificial Sequence
  Description of Artificial Sequence: Synthetic peptide
QSISHY

SEQ ID NO: 63 - protein, 3 aa, Artificial Sequence
  Description of Artificial Sequence: Synthetic peptide
YAS

SEQ ID NO: 64 - protein, 9 aa, Artificial Sequence
  Description of Artificial Sequence: Synthetic peptide
QNGHSFPYT

SEQ ID NO: 65 - protein, 124 aa, Artificial Sequence
  Description of Artificial Sequence: Synthetic polypeptide
EFQLQQSGPELVKPGASVKMSCKASGYTFTDYYMNWVKQSHGKSLQWIGRIIPSNGATIYNQKFKGKATLTVDKSLSTAYMHLNSLTSEDSAVYYCAREDYSNQGFFLDAMDYWGQGTTVTVSS

SEQ ID NO: 66 - protein, 107 aa, Artificial Sequence
  Description of Artificial Sequence: Synthetic polypeptide
DIVMTQSPATLSVTPGDRVSLSCRASQSISHYLHWYQQKLHESPRLLIKYASQSISGIPSRFSGSGSGSDFTLSINSVEPEDVGVYYCQNGHSFPYTFGGGTKLEIK

SEQ ID NO: 67 - protein, 454 aa, Artificial Sequence
  Description of Artificial Sequence: Synthetic polypeptide
EFQLQQSGPELVKPGASVKMSCKASGYTFTDYYMNWVKQSHGKSLQWIGRIIPSNGATIYNQKFKGKATLTVDKSLSTAYMHLNSLTSEDSAVYYCAREDYSNQGFFLDAMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 68 - protein, 214 aa, Artificial Sequence
  Description of Artificial Sequence: Synthetic polypeptide
DIVMTQSPATLSVTPGDRVSLSCRASQSISHYLHWYQQKLHESPRLLIKYASQSISGIPSRFSGSGSGSDFTLSINSVEPEDVGVYYCQNGHSFPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 69 - protein, 5 aa, Artificial Sequence
  Description of Artificial Sequence: Synthetic peptide
DYYMN

SEQ ID NO: 70 - protein, 17 aa, Artificial Sequence
  Description of Artificial Sequence: Synthetic peptide
RVIPSNGGTIYNQKFRG

SEQ ID NO: 71 - protein, 15 aa, Artificial Sequence
  Description of Artificial Sequence: Synthetic peptide
EDYGNQGFFLDAMDY

SEQ ID NO: 72 - protein, 11 aa, Artificial Sequence
  Description of Artificial Sequence: Synthetic peptide
RASQSISHFLH

SEQ ID NO: 73 - protein, 7 aa, Artificial Sequence
  Description of Artificial Sequence: Synthetic peptide
YASQSIS

SEQ ID NO: 74 - protein, 9 aa, Artificial Sequence
  Description of Artificial Sequence: Synthetic peptide
QSGHSFPYT

SEQ ID NO: 75 - protein, 7 aa, Artificial Sequence
  Description of Artificial Sequence: Synthetic peptide
GYTFTDY

SEQ ID NO: 76 - protein, 6 aa, Artificial Sequence
  Description of Artificial Sequence: Synthetic peptide
IPSNGG

SEQ ID NO: 77 - protein, 14 aa, Artificial Sequence
  Description of Artificial Sequence: Synthetic peptide
EDYGNQGFFLDAMD

SEQ ID NO: 78 - protein, 7 aa, Artificial Sequence
  Description of Artificial Sequence: Synthetic peptide
SQSISHF

SEQ ID NO: 79 - protein, 3 aa, Artificial Sequence
  Description of Artificial Sequence: Synthetic peptide
YAS

SEQ ID NO: 80 - protein, 6 aa, Artificial Sequence
  Description of Artificial Sequence: Synthetic peptide
GHSFPY

SEQ ID NO: 81 - protein, 10 aa, Artificial Sequence
  Description of Artificial Sequence: Synthetic peptide
GYTFTDYYMN

SEQ ID NO: 82 - protein, 10 aa, Artificial Sequence
  Description of Artificial Sequence: Synthetic peptide
RVIPSNGGTI

SEQ ID NO: 83 - protein, 15 aa, Artificial Sequence
  Description of Artificial Sequence: Synthetic peptide
EDYGNQGFFLDAMDY

SEQ ID NO: 84 - protein, 11 aa, Artificial Sequence
  Description of Artificial Sequence: Synthetic peptide
RASQSISHFLH

SEQ ID NO: 85 - protein, 7 aa, Artificial Sequence
  Description of Artificial Sequence: Synthetic peptide
YASQSIS

SEQ ID NO: 86 - protein, 9 aa, Artificial Sequence
  Description of Artificial Sequence: Synthetic peptide
QSGHSFPYT

SEQ ID NO: 87 - protein, 6 aa, Artificial Sequence
  Description of Artificial Sequence: Synthetic peptide
TDYYMN

SEQ ID NO: 88 - protein, 13 aa, Artificial Sequence
  Description of Artificial Sequence: Synthetic peptide
WIGRVIPSNGGTI

SEQ ID NO: 89 - protein, 16 aa, Artificial Sequence
  Description of Artificial Sequence: Synthetic peptide
AREDYGNQGFFLDAMD

SEQ ID NO: 90 - protein, 7 aa, Artificial Sequence
  Description of Artificial Sequence: Synthetic peptide
SHFLHWY

SEQ ID NO: 91 - protein, 10 aa, Artificial Sequence
  Description of Artificial Sequence: Synthetic peptide
LLIKYASQSI

SEQ ID NO: 92 - protein, 8 aa, Artificial Sequence
  Description of Artificial Sequence: Synthetic peptide
QSGHSFPY

SEQ ID NO: 93 - protein, 8 aa, Artificial Sequence
  Description of Artificial Sequence: Synthetic peptide
GYTFTDYY

SEQ ID NO: 94 - protein, 8 aa, Artificial Sequence
  Description of Artificial Sequence: Synthetic peptide
VIPSNGGT

SEQ ID NO: 95 - protein, 17 aa, Artificial Sequence
  Description of Artificial Sequence: Synthetic peptide
AREDYGNQGFFLDAMDY

SEQ ID NO: 96 - protein, 6 aa, Artificial Sequence
  Description of Artificial Sequence: Synthetic peptide
QSISHF

SEQ ID NO: 97 - protein, 3 aa, Artificial Sequence
  Description of Artificial Sequence: Synthetic peptide
YAS

SEQ ID NO: 98 - protein, 9 aa, Artificial Sequence
  Description of Artificial Sequence: Synthetic peptide
QSGHSFPYT

SEQ ID NO: 99 - protein, 124 aa, Artificial Sequence
  Description of Artificial Sequence: Synthetic polypeptide
EVQLQQSGPELVKPGASVKMSCKASGYTFTDYYMNWVKQSHGKSLEWIGRVIPSNGGTIYNQKFRGKATLTVDKSLSTAYMQLNSLTSEDSAVYYCAREDYGNQGFFLDAMDYWGQGTTVTVSS

SEQ ID NO: 100 - protein, 107 aa, Artificial Sequence
  Description of Artificial Sequence: Synthetic polypeptide
DIVMTQSPATLSVTPGDRVSLSCRASQSISHFLHWYQQKSHESPRLLIKYASQSISGSPSKFSGSGSGSDFTLTINSVEPEDVGVYYCQSGHSFPYTFGSGTKLEIK

SEQ ID NO: 101 - protein, 454 aa, Artificial Sequence
  Description of Artificial Sequence: Synthetic polypeptide
EVQLQQSGPELVKPGASVKMSCKASGYTFTDYYMNWVKQSHGKSLEWIGRVIPSNGGTIYNQKFRGKATLTVDKSLSTAYMQLNSLTSEDSAVYYCAREDYGNQGFFLDAMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 102 - protein, 214 aa, Artificial Sequence
  Description of Artificial Sequence: Synthetic polypeptide
DIVMTQSPATLSVTPGDRVSLSCRASQSISHFLHWYQQKSHESPRLLIKYASQSISGSPSKFSGSGSGSDFTLTINSVEPEDVGVYYCQSGHSFPYTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 103 - protein, 5 aa, Artificial Sequence
  Description of Artificial Sequence: Synthetic peptide
DYYMN

SEQ ID NO: 104 - protein, 17 aa, Artificial Sequence
  Description of Artificial Sequence: Synthetic peptide
RVIPNNGGTRYNQKFKG

SEQ ID NO: 105 - protein, 15 aa, Artificial Sequence
  Description of Artificial Sequence: Synthetic peptide
EDFSNQGFFLDAMDY

SEQ ID NO: 106 - protein, 11 aa, Artificial Sequence
  Description of Artificial Sequence: Synthetic peptide
RASQTISDYLH

SEQ ID NO: 107 - protein, 7 aa, Artificial Sequence
  Description of Artificial Sequence: Synthetic peptide
YASQSIS

SEQ ID NO: 108 - protein, 9 aa, Artificial Sequence
  Description of Artificial Sequence: Synthetic peptide
QNGHSFPYT

SEQ ID NO: 109 - protein, 7 aa, Artificial Sequence
  Description of Artificial Sequence: Synthetic peptide
GYTFTDY

SEQ ID NO: 110 - protein, 6 aa, Artificial Sequence
  Description of Artificial Sequence: Synthetic peptide
IPNNGG

SEQ ID NO: 111 - protein, 14 aa, Artificial Sequence
  Description of Artificial Sequence: Synthetic peptide
EDFSNQGFFLDAMD

SEQ ID NO: 112 - protein, 7 aa, Artificial Sequence
  Description of Artificial Sequence: Synthetic peptide
SQTISDY

SEQ ID NO: 113 - protein, 3 aa, Artificial Sequence
  Description of Artificial Sequence: Synthetic peptide
YAS

SEQ ID NO: 114 - protein, 6 aa, Artificial Sequence
  Description of Artificial Sequence: Synthetic peptide
GHSFPY

SEQ ID NO: 115 - protein, 10 aa, Artificial Sequence
  Description of Artificial Sequence: Synthetic peptide
GYTFTDYYMN

SEQ ID NO: 116 - protein, 10 aa, Artificial Sequence
  Description of Artificial Sequence: Synthetic peptide
RVIPNNGGTR

SEQ ID NO: 117 - protein, 15 aa, Artificial Sequence
  Description of Artificial Sequence: Synthetic peptide
EDFSNQGFFLDAMDY

SEQ ID NO: 118 - protein, 11 aa, Artificial Sequence
  Description of Artificial Sequence: Synthetic peptide
RASQTISDYLH

SEQ ID NO: 119 - protein, 7 aa, Artificial Sequence
  Description of Artificial Sequence: Synthetic peptide
YASQSIS

SEQ ID NO: 120 - protein, 9 aa, Artificial Sequence
  Description of Artificial Sequence: Synthetic peptide
QNGHSFPYT

SEQ ID NO: 121 - protein, 6 aa, Artificial Sequence
  Description of Artificial Sequence: Synthetic peptide
TDYYMN

SEQ ID NO: 122 - protein, 13 aa, Artificial Sequence
  Description of Artificial Sequence: Synthetic peptide
WIGRVIPNNGGTR

SEQ ID NO: 123 - protein, 16 aa, Artificial Sequence
  Description of Artificial Sequence: Synthetic peptide
AREDFSNQGFFLDAMD

SEQ ID NO: 124 - protein, 7 aa, Artificial Sequence
  Description of Artificial Sequence: Synthetic peptide
SDYLHWY

SEQ ID NO: 125 - protein, 10 aa, Artificial Sequence
  Description of Artificial Sequence: Synthetic peptide
LLIKYASQSI

SEQ ID NO: 126 - protein, 8 aa, Artificial Sequence
  Description of Artificial Sequence: Synthetic peptide
QNGHSFPY

SEQ ID NO: 127 - protein, 8 aa, Artificial Sequence
  Description of Artificial Sequence: Synthetic peptide
GYTFTDYY

SEQ ID NO: 128 - protein, 8 aa, Artificial Sequence
  Description of Artificial Sequence: Synthetic peptide
VIPNNGGT

SEQ ID NO: 129 - protein, 17 aa, Artificial Sequence
  Description of Artificial Sequence: Synthetic peptide
AREDFSNQGFFLDAMDY

SEQ ID NO: 130 - protein, 6 aa, Artificial Sequence
  Description of Artificial Sequence: Synthetic peptide
QTISDY

SEQ ID NO: 131 - protein, 3 aa, Artificial Sequence
  Description of Artificial Sequence: Synthetic peptide
YAS

SEQ ID NO: 132 - protein, 9 aa, Artificial Sequence
  Description of Artificial Sequence: Synthetic peptide
QNGHSFPYT

SEQ ID NO: 133 - protein, 124 aa, Artificial Sequence
  Description of Artificial Sequence: Synthetic polypeptide
QVQLQQSGPELVKPGASVKMSCKASGYTFTDYYMNWVKQSHGKSLEWIGRVIPNNGGTRYNQKFKGKATLTVDKSLSTAYMQLNSLTSEDSAVYYCAREDFSNQGFFLDAMDYWGQGTSVTVSS

SEQ ID NO: 134 - protein, 107 aa, Artificial Sequence
  Description of Artificial Sequence: Synthetic polypeptide
DIVMTQSPATLSVTPGDRVSLSCRASQTISDYLHWYQQKSHESPRLLIKYASQSISGIPSRFSGSGSGSDFTLSINSVEPEDVGVYYCQNGHSFPYTFGAGTKLELK

SEQ ID NO: 135 - protein, 454 aa, Artificial Sequence
  Description of Artificial Sequence: Synthetic polypeptide
QVQLQQSGPELVKPGASVKMSCKASGYTFTDYYMNWVKQSHGKSLEWIGRVIPNNGGTRYNQKFKGKATLTVDKSLSTAYMQLNSLTSEDSAVYYCAREDFSNQGFFLDAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 136 - protein, 214 aa, Artificial Sequence
  Description of Artificial Sequence: Synthetic polypeptide
DIVMTQSPATLSVTPGDRVSLSCRASQTISDYLHWYQQKSHESPRLLIKYASQSISGIPSRFSGSGSGSDFTLSINSVEPEDVGVYYCQNGHSFPYTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 137 - protein, 5 aa, Artificial Sequence
  Description of Artificial Sequence: Synthetic peptide
DYYVN

SEQ ID NO: 138 - protein, 17 aa, Artificial Sequence
  Description of Artificial Sequence: Synthetic peptide
RVIPNNGNVIYNQNFKG

SEQ ID NO: 139 - protein, 15 aa, Artificial Sequence
  Description of Artificial Sequence: Synthetic peptide
EDYSNQGFFLDAMDY

SEQ ID NO: 140 - protein, 11 aa, Artificial Sequence
  Description of Artificial Sequence: Synthetic peptide
RASQTISNYLH

SEQ ID NO: 141 - protein, 7 aa, Artificial Sequence
  Description of Artificial Sequence: Synthetic peptide
YASQSIS

SEQ ID NO: 142 - protein, 9 aa, Artificial Sequence
  Description of Artificial Sequence: Synthetic peptide
QNGHSFPYT

SEQ ID NO: 143 - protein, 7 aa, Artificial Sequence
  Description of Artificial Sequence: Synthetic peptide
GYTFTDY

SEQ ID NO: 144 - protein, 6 aa, Artificial Sequence
  Description of Artificial Sequence: Synthetic peptide
IPNNGN

SEQ ID NO: 145 - protein, 14 aa, Artificial Sequence
  Description of Artificial Sequence: Synthetic peptide
EDYSNQGFFLDAMD

SEQ ID NO: 146 - protein, 7 aa, Artificial Sequence
  Description of Artificial Sequence: Synthetic peptide
SQTISNY

SEQ ID NO: 147 - protein, 3 aa, Artificial Sequence
  Description of Artificial Sequence: Synthetic peptide
YAS

SEQ ID NO: 148 - protein, 6 aa, Artificial Sequence
  Description of Artificial Sequence: Synthetic peptide
GHSFPY

SEQ ID NO: 149 - protein, 10 aa, Artificial Sequence
  Description of Artificial Sequence: Synthetic peptide
GYTFTDYYVN

SEQ ID NO: 150 - protein, 10 aa, Artificial Sequence
  Description of Artificial Sequence: Synthetic peptide
RVIPNNGNVI

SEQ ID NO: 151 - protein, 15 aa, Artificial Sequence
  Description of Artificial Sequence: Synthetic peptide
EDYSNQGFFLDAMDY

SEQ ID NO: 152 - protein, 11 aa, Artificial Sequence
  Description of Artificial Sequence: Synthetic peptide
RASQTISNYLH

SEQ ID NO: 153 - protein, 7 aa, Artificial Sequence
  Description of Artificial Sequence: Synthetic peptide
YASQSIS

SEQ ID NO: 154 - protein, 9 aa, Artificial Sequence
  Description of Artificial Sequence: Synthetic peptide
QNGHSFPYT

SEQ ID NO: 155 - protein, 6 aa, Artificial Sequence
  Description of Artificial Sequence: Synthetic peptide
TDYYVN

SEQ ID NO: 156 - protein, 13 aa, Artificial Sequence
  Description of Artificial Sequence: Synthetic peptide
WIGRVIPNNGNVI

SEQ ID NO: 157 - protein, 16 aa, Artificial Sequence
  Description of Artificial Sequence: Synthetic peptide
TREDYSNQGFFLDAMD

SEQ ID NO: 158 - protein, 7 aa, Artificial Sequence
  Description of Artificial Sequence: Synthetic peptide
SNYLHWY

SEQ ID NO: 159 - protein, 10 aa, Artificial Sequence
  Description of Artificial Sequence: Synthetic peptide
LLIKYASQSI

SEQ ID NO: 160 - protein, 8 aa, Artificial Sequence
  Description of Artificial Sequence: Synthetic peptide
QNGHSFPY

SEQ ID NO: 161 - protein, 8 aa, Artificial Sequence
  Description of Artificial Sequence: Synthetic peptide
GYTFTDYY

SEQ ID NO: 162 - protein, 8 aa, Artificial Sequence
  Description of Artificial Sequence: Synthetic peptide
VIPNNGNV

SEQ ID NO: 163 - protein, 17 aa, Artificial Sequence
  Description of Artificial Sequence: Synthetic peptide
TREDYSNQGFFLDAMDY

SEQ ID NO: 164 - protein, 6 aa, Artificial Sequence
  Description of Artificial Sequence: Synthetic peptide
QTISNY

SEQ ID NO: 165 - protein, 3 aa, Artificial Sequence
  Description of Artificial Sequence: Synthetic peptide
YAS

SEQ ID NO: 166 - protein, 9 aa, Artificial Sequence
  Description of Artificial Sequence: Synthetic peptide
QNGHSFPYT

SEQ ID NO: 167 - protein, 124 aa, Artificial Sequence
  Description of Artificial Sequence: Synthetic polypeptide
EFQLQQSGPELVKPGASVKVSCKASGYTFTDYYVNWVQQSHGKSLEWIGRVIPNNGNVIYNQNFKGKATLTVDKSLSSAYLQLNSLTSEDSAVYYCTREDYSNQGFFLDAMDYWGQGTSVTVSS

SEQ ID NO: 168 - protein, 107 aa, Artificial Sequence
  Description of Artificial Sequence: Synthetic polypeptide
DIVMTQTPATLSVTPGDRVSLSCRASQTISNYLHWYQQKSHESPRLLIKYASQSISGIPSRFSGSGSGSDFTLSINSVEPEDVGVYYCQNGHSFPYTFGGGTKLEIK

SEQ ID NO: 169 - protein, 454 aa, Artificial Sequence
  Description of Artificial Sequence: Synthetic polypeptide
EFQLQQSGPELVKPGASVKVSCKASGYTFTDYYVNWVQQSHGKSLEWIGRVIPNNGNVIYNQNFKGKATLTVDKSLSSAYLQLNSLTSEDSAVYYCTREDYSNQGFFLDAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 170 - protein, 214 aa, Artificial Sequence
  Description of Artificial Sequence: Synthetic polypeptide
DIVMTQTPATLSVTPGDRVSLSCRASQTISNYLHWYQQKSHESPRLLIKYASQSISGIPSRFSGSGSGSDFTLSINSVEPEDVGVYYCQNGHSFPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 171 - protein, 5 aa, Artificial Sequence
  Description of Artificial Sequence: Synthetic peptide
SYWMH

SEQ ID NO: 172 - protein, 17 aa, Artificial Sequence
  Description of Artificial Sequence: Synthetic peptide
EINPSNGDSYYNEKFKR

SEQ ID NO: 173 - protein, 11 aa, Artificial Sequence
  Description of Artificial Sequence: Synthetic peptide
SMYYDGRAGAY

SEQ ID NO: 174 - protein, 11 aa, Artificial Sequence
  Description of Artificial Sequence: Synthetic peptide
ITSTDIDDDMN

SEQ ID NO: 175 - protein, 7 aa, Artificial Sequence
  Description of Artificial Sequence: Synthetic peptide
EGNTLRP

SEQ ID NO: 176 - protein, 9 aa, Artificial Sequence
  Description of Artificial Sequence: Synthetic peptide
LQSDNMPLT

SEQ ID NO: 177 - protein, 7 aa, Artificial Sequence
  Description of Artificial Sequence: Synthetic peptide
GYTFTSY

SEQ ID NO: 178 - protein, 6 aa, Artificial Sequence
  Description of Artificial Sequence: Synthetic peptide
NPSNGD

SEQ ID NO: 179 - protein, 10 aa, Artificial Sequence
  Description of Artificial Sequence: Synthetic peptide
SMYYDGRAGA

SEQ ID NO: 180 - protein, 7 aa, Artificial Sequence
  Description of Artificial Sequence: Synthetic peptide
STDIDDD

SEQ ID NO: 181 - protein, 3 aa, Artificial Sequence
  Description of Artificial Sequence: Synthetic peptide
EGN

SEQ ID NO: 182 - protein, 6 aa, Artificial Sequence
  Description of Artificial Sequence: Synthetic peptide
SDNMPL

SEQ ID NO: 183 - protein, 10 aa, Artificial Sequence
  Description of Artificial Sequence: Synthetic peptide
GYTFTSYWMH

SEQ ID NO: 184 - protein, 10 aa, Artificial Sequence
  Description of Artificial Sequence: Synthetic peptide
EINPSNGDSY

SEQ ID NO: 185 - protein, 11 aa, Artificial Sequence
  Description of Artificial Sequence: Synthetic peptide
SMYYDGRAGAY

SEQ ID NO: 186 - protein, 11 aa, Artificial Sequence
  Description of Artificial Sequence: Synthetic peptide
ITSTDIDDDMN

SEQ ID NO: 187 - protein, 7 aa, Artificial Sequence
  Description of Artificial Sequence: Synthetic peptide
EGNTLRP

SEQ ID NO: 188 - protein, 9 aa, Artificial Sequence
  Description of Artificial Sequence: Synthetic peptide
LQSDNMPLT

SEQ ID NO: 189 - protein, 6 aa, Artificial Sequence
  Description of Artificial Sequence: Synthetic peptide
TSYWMH

SEQ ID NO: 190 - protein, 13 aa, Artificial Sequence
  Description of Artificial Sequence: Synthetic peptide
WIGEINPSNGDSY

SEQ ID NO: 191 - protein, 12 aa, Artificial Sequence
  Description of Artificial Sequence: Synthetic peptide
TRSMYYDGRAGA

SEQ ID NO: 192 - protein, 7 aa, Artificial Sequence
  Description of Artificial Sequence: Synthetic peptide
DDDMNWY

SEQ ID NO: 193 - protein, 10 aa, Artificial Sequence
  Description of Artificial Sequence: Synthetic peptide
LLISEGNTLR

SEQ ID NO: 194 - protein, 8 aa, Artificial Sequence
  Description of Artificial Sequence: Synthetic peptide
LQSDNMPL

SEQ ID NO: 195 - protein, 8 aa, Artificial Sequence
  Description of Artificial Sequence: Synthetic peptide
GYTFTSYW

SEQ ID NO: 196 - protein, 8 aa, Artificial Sequence
  Description of Artificial Sequence: Synthetic peptide
INPSNGDS

SEQ ID NO: 197 - protein, 13 aa, Artificial Sequence
  Description of Artificial Sequence: Synthetic peptide
TRSMYYDGRAGAY

SEQ ID NO: 198 - protein, 6 aa, Artificial Sequence
  Description of Artificial Sequence: Synthetic peptide
TDIDDD

SEQ ID NO: 199 - protein, 3 aa, Artificial Sequence
  Description of Artificial Sequence: Synthetic peptide
EGN

SEQ ID NO: 200 - protein, 9 aa, Artificial Sequence
  Description of Artificial Sequence: Synthetic peptide
LQSDNMPLT

SEQ ID NO: 201 - protein, 120 aa, Artificial Sequence
  Description of Artificial Sequence: Synthetic polypeptide
QVQLQQPGAELVKPGASVKLSCKASGYTFTSYWMHWVNRRPGQGLEWIGEINPSNGDSYYNEKFKRKATLTVDISSSTAYMQLSSLTSEDSAVYYCTRSMYYDGRAGAYWGQGTTVTVSS

SEQ ID NO: 202 - protein, 107 aa, Artificial Sequence
  Description of Artificial Sequence: Synthetic polypeptide
DIVLTQSPASLSVATGEKVTIRCITSTDIDDDMNWYQQKPGEPPKLLISEGNTLRPGVPSRFSSSGYGTDFVFTIENTLSEDVADYYCLQSDNMPLTFGAGTKLELK

SEQ ID NO: 203 - protein, 450 aa, Artificial Sequence
  Description of Artificial Sequence: Synthetic polypeptide
QVQLQQPGAELVKPGASVKLSCKASGYTFTSYWMHWVNRRPGQGLEWIGEINPSNGDSYYNEKFKRKATLTVDISSSTAYMQLSSLTSEDSAVYYCTRSMYYDGRAGAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 204 - protein, 214 aa, Artificial Sequence
  Description of Artificial Sequence: Synthetic polypeptide
DIVLTQSPASLSVATGEKVTIRCITSTDIDDDMNWYQQKPGEPPKLLISEGNTLRPGVPSRFSSSGYGTDFVFTIENTLSEDVADYYCLQSDNMPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205 - protein, 5 aa, Artificial Sequence
  Description of Artificial Sequence: Synthetic peptide
NYWIH

SEQ ID NO: 206 - protein, 17 aa, Artificial Sequence
  Description of Artificial Sequence: Synthetic peptide
NIDPSDSETHYNQKFKD

SEQ ID NO: 207 - protein, 8 aa, Artificial Sequence
  Description of Artificial Sequence: Synthetic peptide
GLTGTGYY

SEQ ID NO: 208 - protein, 11 aa, Artificial Sequence
  Description of Artificial Sequence: Synthetic peptide
RASQDISPYLN

SEQ ID NO: 209 - protein, 7 aa, Artificial Sequence
  Description of Artificial Sequence: Synthetic peptide
YTSKLHS

SEQ ID NO: 210 - protein, 9 aa, Artificial Sequence
  Description of Artificial Sequence: Synthetic peptide
QQDNTLPYT

SEQ ID NO: 211 - protein, 7 aa, Artificial Sequence
  Description of Artificial Sequence: Synthetic peptide
GYTFTNY

SEQ ID NO: 212 - protein, 6 aa, Artificial Sequence
  Description of Artificial Sequence: Synthetic peptide
DPSDSE

SEQ ID NO: 213 - protein, 7 aa, Artificial Sequence
  Description of Artificial Sequence: Synthetic peptide
GLTGTGY

SEQ ID NO: 214 - protein, 7 aa, Artificial Sequence
  Description of Artificial Sequence: Synthetic peptide
SQDISPY

SEQ ID NO: 215 - protein, 3 aa, Artificial Sequence
  Description of Artificial Sequence: Synthetic peptide
YTS

SEQ ID NO: 216 - protein, 6 aa, Artificial Sequence
  Description of Artificial Sequence: Synthetic peptide
DNTLPY

SEQ ID NO: 217 - protein, 10 aa, Artificial Sequence
  Description of Artificial Sequence: Synthetic peptide
GYTFTNYWIH

SEQ ID NO: 218 - protein, 10 aa, Artificial Sequence
  Description of Artificial Sequence: Synthetic peptide
NIDPSDSETH

SEQ ID NO: 219 - protein, 8 aa, Artificial Sequence
  Description of Artificial Sequence: Synthetic peptide
GLTGTGYY

SEQ ID NO: 220 - protein, 11 aa, Artificial Sequence
  Description of Artificial Sequence: Synthetic peptide
RASQDISPYLN

SEQ ID NO: 221 - protein, 7 aa, Artificial Sequence
  Description of Artificial Sequence: Synthetic peptide
YTSKLHS

SEQ ID NO: 222 - protein, 9 aa, Artificial Sequence
  Description of Artificial Sequence: Synthetic peptide
QQDNTLPYT

SEQ ID NO: 223 - protein, 6 aa, Artificial Sequence
  Description of Artificial Sequence: Synthetic peptide
TNYWIH

SEQ ID NO: 224 - protein, 13 aa, Artificial Sequence
  Description of Artificial Sequence: Synthetic peptide
WIGNIDPSDSETH

SEQ ID NO: 225 - protein, 9 aa, Artificial Sequence
  Description of Artificial Sequence: Synthetic peptide
ASGLTGTGY

SEQ ID NO: 226 - protein, 7 aa, Artificial Sequence
  Description of Artificial Sequence: Synthetic peptide
SPYLNWY

SEQ ID NO: 227 - protein, 10 aa, Artificial Sequence
  Description of Artificial Sequence: Synthetic peptide
LLIYYTSKLH

SEQ ID NO: 228 - protein, 8 aa, Artificial Sequence
  Description of Artificial Sequence: Synthetic peptide
QQDNTLPY

SEQ ID NO: 229 - protein, 8 aa, Artificial Sequence
  Description of Artificial Sequence: Synthetic peptide
GYTFTNYW

SEQ ID NO: 230 - protein, 8 aa, Artificial Sequence
  Description of Artificial Sequence: Synthetic peptide
IDPSDSET

SEQ ID NO: 231 - protein, 10 aa, Artificial Sequence
  Description of Artificial Sequence: Synthetic peptide
ASGLTGTGYY

SEQ ID NO: 232 - protein, 6 aa, Artificial Sequence
  Description of Artificial Sequence: Synthetic peptide
QDISPY

SEQ ID NO: 233 - protein, 3 aa, Artificial Sequence
  Description of Artificial Sequence: Synthetic peptide
YTS

SEQ ID NO: 234 - protein, 9 aa, Artificial Sequence
  Description of Artificial Sequence: Synthetic peptide
QQDNTLPYT

SEQ ID NO: 235 - protein, 117 aa, Artificial Sequence
  Description of Artificial Sequence: Synthetic polypeptide
EVQLQQSGAELVKPGASVKLSCKASGYTFTNYWIHWVKQRPGQGLEWIGNIDPSDSETHYNQKFKDKATLTVDKSSSTAYMQLISLTSEDSAVYYCASGLTGTGYYWGQGTTLTVSS

SEQ ID NO: 236 - protein, 107 aa, Artificial Sequence
  Description of Artificial Sequence: Synthetic polypeptide
DIQMTQTTSSLSASLGDRVTITCRASQDISPYLNWYQQKPEGTIKLLIYYTSKLHSGVPSRFSGSGSGTDYSLTISNLEQEDIATYFCQQDNTLPYTFGSGTKLELK

SEQ ID NO: 237 - protein, 447 aa, Artificial Sequence
  Description of Artificial Sequence: Synthetic polypeptide
EVQLQQSGAELVKPGASVKLSCKASGYTFTNYWIHWVKQRPGQGLEWIGNIDPSDSETHYNQKFKDKATLTVDKSSSTAYMQLISLTSEDSAVYYCASGLTGTGYYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 238 - protein, 214 aa, Artificial Sequence
  Description of Artificial Sequence: Synthetic polypeptide
DIQMTQTTSSLSASLGDRVTITCRASQDISPYLNWYQQKPEGTIKLLIYYTSKLHSGVPSRFSGSGSGTDYSLTISNLEQEDIATYFCQQDNTLPYTFGSGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 239 - protein, 5 aa, Artificial Sequence
  Description of Artificial Sequence: Synthetic peptide
DYYMN

SEQ ID NO: 240 - protein, 17 aa, Artificial Sequence
  Description of Artificial Sequence: Synthetic peptide
RVIPNNGGTIYNQKFKD

SEQ ID NO: 241 - protein, 15 aa, Artificial Sequence
  Description of Artificial Sequence: Synthetic peptide
EDYSNQGFFLDAMDY

SEQ ID NO: 242 - protein, 11 aa, Artificial Sequence
  Description of Artificial Sequence: Synthetic peptide
RASQTISHFLH

SEQ ID NO: 243 - protein, 7 aa, Artificial Sequence
  Description of Artificial Sequence: Synthetic peptide
YASQSIS

SEQ ID NO: 244 - protein, 9 aa, Artificial Sequence
  Description of Artificial Sequence: Synthetic peptide
QSGHSFPYT

SEQ ID NO: 245 - protein, 7 aa, Artificial Sequence
  Description of Artificial Sequence: Synthetic peptide
GYTFTDY

SEQ ID NO: 246 - protein, 6 aa, Artificial Sequence
  Description of Artificial Sequence: Synthetic peptide
IPNNGG

SEQ ID NO: 247 - protein, 14 aa, Artificial Sequence
  Description of Artificial Sequence: Synthetic peptide
EDYSNQGFFLDAMD

SEQ ID NO: 248 - protein, 7 aa, Artificial Sequence
  Description of Artificial Sequence: Synthetic peptide
SQTISHF

SEQ ID NO: 249 - protein, 3 aa, Artificial Sequence
  Description of Artificial Sequence: Synthetic peptide
YAS

SEQ ID NO: 250 - protein, 6 aa, Artificial Sequence
  Description of Artificial Sequence: Synthetic peptide
GHSFPY

SEQ ID NO: 251 - protein, 10 aa, Artificial Sequence
  Description of Artificial Sequence: Synthetic peptide
GYTFTDYYMN

SEQ ID NO: 252 - protein, 10 aa, Artificial Sequence
  Description of Artificial Sequence: Synthetic peptide
RVIPNNGGTI

SEQ ID NO: 253 - protein, 15 aa, Artificial Sequence
  Description of Artificial Sequence: Synthetic peptide
EDYSNQGFFLDAMDY

SEQ ID NO: 254 - protein, 11 aa, Artificial Sequence
  Description of Artificial Sequence: Synthetic peptide
RASQTISHFLH

SEQ ID NO: 255 - protein, 7 aa, Artificial Sequence
  Description of Artificial Sequence: Synthetic peptide
YASQSIS

SEQ ID NO: 256 - protein, 9 aa, Artificial Sequence
  Description of Artificial Sequence: Synthetic peptide
QSGHSFPYT

SEQ ID NO: 257 - protein, 6 aa, Artificial Sequence
  Description of Artificial Sequence: Synthetic peptide
TDYYMN

SEQ ID NO: 258 - protein, 13 aa, Artificial Sequence
  Description of Artificial Sequence: Synthetic peptide
WIGRVIPNNGGTI

SEQ ID NO: 259 - protein, 16 aa, Artificial Sequence
  Description of Artificial Sequence: Synthetic peptide
AREDYSNQGFFLDAMD

SEQ ID NO: 260 - protein, 7 aa, Artificial Sequence
  Description of Artificial Sequence: Synthetic peptide
SHFLHWY

SEQ ID NO: 261 - protein, 10 aa, Artificial Sequence
  Description of Artificial Sequence: Synthetic peptide
LLIKYASQSI

SEQ ID NO: 262 - protein, 8 aa, Artificial Sequence
  Description of Artificial Sequence: Synthetic peptide
QSGHSFPY

SEQ ID NO: 263 - protein, 8 aa, Artificial Sequence
  Description of Artificial Sequence: Synthetic peptide
GYTFTDYY

SEQ ID NO: 264 - protein, 8 aa, Artificial Sequence
  Description of Artificial Sequence: Synthetic peptide
VIPNNGGT

SEQ ID NO: 265 - protein, 17 aa, Artificial Sequence
  Description of Artificial Sequence: Synthetic peptide
AREDYSNQGFFLDAMDY

SEQ ID NO: 266 - protein, 6 aa, Artificial Sequence
  Description of Artificial Sequence: Synthetic peptide
QTISHF

SEQ ID NO: 267 - protein, 3 aa, Artificial Sequence
  Description of Artificial Sequence: Synthetic peptide
YAS

SEQ ID NO: 268 - protein, 9 aa, Artificial Sequence
  Description of Artificial Sequence: Synthetic peptide
QSGHSFPYT

SEQ ID NO: 269 - protein, 124 aa, Artificial Sequence
  Description of Artificial Sequence: Synthetic polypeptide
EVQLQQSGPELVKPGASVKMSCKASGYTFTDYYMNWVKQSHGKSLEWIGRVIPNNGGTIYNQKFKDKATLTVDKSLSTAYMQLNSLTSEDSAVYYCAREDYSNQGFFLDAMDYWGQGTSVTVSS

SEQ ID NO: 270 - protein, 107 aa, Artificial Sequence
  Description of Artificial Sequence: Synthetic polypeptide
DIVMTQSPATLSVTPGERVSLSCRASQTISHFLHWYQQKSHESPRLLIKYASQSISGIPSRFSGGGSGSDFILTINSVEPEDVGMYYCQSGHSFPYTFGSGTKLEIK

SEQ ID NO: 271 - protein, 454 aa, Artificial Sequence
  Description of Artificial Sequence: Synthetic polypeptide
EVQLQQSGPELVKPGASVKMSCKASGYTFTDYYMNWVKQSHGKSLEWIGRVIPNNGGTIYNQKFKDKATLTVDKSLSTAYMQLNSLTSEDSAVYYCAREDYSNQGFFLDAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 272 - protein, 214 aa, Artificial Sequence
  Description of Artificial Sequence: Synthetic polypeptide
DIVMTQSPATLSVTPGERVSLSCRASQTISHFLHWYQQKSHESPRLLIKYASQSISGIPSRFSGGGSGSDFILTINSVEPEDVGMYYCQSGHSFPYTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 273 - protein, 5 aa, Artificial Sequence
  Description of Artificial Sequence: Synthetic peptide
DYYMN

SEQ ID NO: 274 - protein, 17 aa, Artificial Sequence
  Description of Artificial Sequence: Synthetic peptide
RVIPRNGATTYNQNFRG

SEQ ID NO: 275 - protein, 15 aa, Artificial Sequence
  Description of Artificial Sequence: Synthetic peptide
EDFSNQGFFLDAMDY

SEQ ID NO: 276 - protein, 11 aa, Artificial Sequence
  Description of Artificial Sequence: Synthetic peptide
RASQSISHYLH

SEQ ID NO: 277 - protein, 7 aa, Artificial Sequence
  Description of Artificial Sequence: Synthetic peptide
YASQSIS

SEQ ID NO: 278 - protein, 9 aa, Artificial Sequence
  Description of Artificial Sequence: Synthetic peptide
QNGHSFPYT

SEQ ID NO: 279 - protein, 7 aa, Artificial Sequence
  Description of Artificial Sequence: Synthetic peptide
GYSFTDY

SEQ ID NO: 280 - protein, 6 aa, Artificial Sequence
  Description of Artificial Sequence: Synthetic peptide
IPRNGA

SEQ ID NO: 281 - protein, 14 aa, Artificial Sequence
  Description of Artificial Sequence: Synthetic peptide
EDFSNQGFFLDAMD

SEQ ID NO: 282 - protein, 7 aa, Artificial Sequence
  Description of Artificial Sequence: Synthetic peptide
SQSISHY

SEQ ID NO: 283 - protein, 3 aa, Artificial Sequence
  Description of Artificial Sequence: Synthetic peptide
YAS

SEQ ID NO: 284 - protein, 6 aa, Artificial Sequence
  Description of Artificial Sequence: Synthetic peptide
GHSFPY

SEQ ID NO: 285 - protein, 10 aa, Artificial Sequence
  Description of Artificial Sequence: Synthetic peptide
GYSFTDYYMN

SEQ ID NO: 286 - protein, 10 aa, Artificial Sequence
  Description of Artificial Sequence: Synthetic peptide
RVIPRNGATT

SEQ ID NO: 287 - protein, 15 aa, Artificial Sequence
  Description of Artificial Sequence: Synthetic peptide
EDFSNQGFFLDAMDY

SEQ ID NO: 288 - protein, 11 aa, Artificial Sequence
  Description of Artificial Sequence: Synthetic peptide
RASQSISHYLH

SEQ ID NO: 289 - protein, 7 aa, Artificial Sequence
  Description of Artificial Sequence: Synthetic peptide
YASQSIS

SEQ ID NO: 290 - protein, 9 aa, Artificial Sequence
  Description of Artificial Sequence: Synthetic peptide
QNGHSFPYT

SEQ ID NO: 291 - protein, 6 aa, Artificial Sequence
  Description of Artificial Sequence: Synthetic peptide
TDYYMN

SEQ ID NO: 292 - protein, 13 aa, Artificial Sequence
  Description of Artificial Sequence: Synthetic peptide
WIGRVIPRNGATT

SEQ ID NO: 293 - protein, 16 aa, Artificial Sequence
  Description of Artificial Sequence: Synthetic peptide
AREDFSNQGFFLDAMD

SEQ ID NO: 294 - protein, 7 aa, Artificial Sequence
  Description of Artificial Sequence: Synthetic peptide
SHYLHWY

SEQ ID NO: 295 - protein, 10 aa, Artificial Sequence
  Description of Artificial Sequence: Synthetic peptide
LLIKYASQSI

SEQ ID NO: 296 - protein, 8 aa, Artificial Sequence
  Description of Artificial Sequence: Synthetic peptide
QNGHSFPY

SEQ ID NO: 297 - protein, 8 aa, Artificial Sequence
  Description of Artificial Sequence: Synthetic peptide
GYSFTDYY

SEQ ID NO: 298 - protein, 8 aa, Artificial Sequence
  Description of Artificial Sequence: Synthetic peptide
VIPRNGAT

SEQ ID NO: 299 - protein, 17 aa, Artificial Sequence
  Description of Artificial Sequence: Synthetic peptide
AREDFSNQGFFLDAMDY

SEQ ID NO: 300 - protein, 6 aa, Artificial Sequence
  Description of Artificial Sequence: Synthetic peptide
QSISHY

SEQ ID NO: 301 - protein, 3 aa, Artificial Sequence
  Description of Artificial Sequence: Synthetic peptide
YAS

SEQ ID NO: 302 - protein, 9 aa, Artificial Sequence
  Description of Artificial Sequence: Synthetic peptide
QNGHSFPYT

SEQ ID NO: 303 - protein, 124 aa, Artificial Sequence
  Description of Artificial Sequence: Synthetic polypeptide
QVQLQQSGPELVKPGASVKMSCKASGYSFTDYYMNWVKQSHGQSLEWIGRVIPRNGATTYNQNFRGKATLTVDISLRTAYMHLNSLTSDDSAVYYCAREDFSNQGFFLDAMDYWGQGTSVTVSS

SEQ ID NO: 304 - protein, 107 aa, Artificial Sequence
  Description of Artificial Sequence: Synthetic polypeptide
DIVMTQSPATLSVTPGDRVSLSCRASQSISHYLHWYQQKSHESPRLLIKYASQSISGIPSRFSGSGSGSDFTLSINSVEPEDVGVYYCQNGHSFPYTFGSGTKLEMK

SEQ ID NO: 305 - protein, 454 aa, Artificial Sequence
  Description of Artificial Sequence: Synthetic polypeptide
QVQLQQSGPELVKPGASVKMSCKASGYSFTDYYMNWVKQSHGQSLEWIGRVIPRNGATTYNQNFRGKATLTVDISLRTAYMHLNSLTSDDSAVYYCAREDFSNQGFFLDAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 306 - protein, 214 aa, Artificial Sequence
  Description of Artificial Sequence: Synthetic polypeptide
DIVMTQSPATLSVTPGDRVSLSCRASQSISHYLHWYQQKSHESPRLLIKYASQSISGIPSRFSGSGSGSDFTLSINSVEPEDVGVYYCQNGHSFPYTFGSGTKLEMKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 307 - protein, 5 aa, Artificial Sequence
  Description of Artificial Sequence: Synthetic peptide
NYWMH

SEQ ID NO: 308 - protein, 17 aa, Artificial Sequence
  Description of Artificial Sequence: Synthetic peptide
NIDPSDSETHYNQKFKD

SEQ ID NO: 309 - protein, 8 aa, Artificial Sequence
  Description of Artificial Sequence: Synthetic peptide
GLTGTGYY

SEQ ID NO: 310 - protein, 11 aa, Artificial Sequence
  Description of Artificial Sequence: Synthetic peptide
RASQDIRPYLN

SEQ ID NO: 311 - protein, 7 aa, Artificial Sequence
  Description of Artificial Sequence: Synthetic peptide
FTSKLHS

SEQ ID NO: 312 - protein, 9 aa, Artificial Sequence
  Description of Artificial Sequence: Synthetic peptide
QQDNTLPYT

SEQ ID NO: 313 - protein, 7 aa, Artificial Sequence
  Description of Artificial Sequence: Synthetic peptide
GYTFTNY

SEQ ID NO: 314 - protein, 6 aa, Artificial Sequence
  Description of Artificial Sequence: Synthetic peptide
DPSDSE

SEQ ID NO: 315 - protein, 7 aa, Artificial Sequence
  Description of Artificial Sequence: Synthetic peptide
GLTGTGY

SEQ ID NO: 316 - protein, 7 aa, Artificial Sequence
  Description of Artificial Sequence: Synthetic peptide
SQDIRPY

SEQ ID NO: 317 - protein, 3 aa, Artificial Sequence
  Description of Artificial Sequence: Synthetic peptide
FTS

SEQ ID NO: 318 - protein, 6 aa, Artificial Sequence
  Description of Artificial Sequence: Synthetic peptide
DNTLPY

SEQ ID NO: 319 - protein, 10 aa, Artificial Sequence
  Description of Artificial Sequence: Synthetic peptide
GYTFTNYWMH

SEQ ID NO: 320 - protein, 10 aa, Artificial Sequence
  Description of Artificial Sequence: Synthetic peptide
NIDPSDSETH

SEQ ID NO: 321 - protein, 8 aa, Artificial Sequence
  Description of Artificial Sequence: Synthetic peptide
GLTGTGYY

SEQ ID NO: 322 - protein, 11 aa, Artificial Sequence
  Description of Artificial Sequence: Synthetic peptide
RASQDIRPYLN

SEQ ID NO: 323 - protein, 7 aa, Artificial Sequence
  Description of Artificial Sequence: Synthetic peptide
FTSKLHS

SEQ ID NO: 324 - protein, 9 aa, Artificial Sequence
  Description of Artificial Sequence: Synthetic peptide
QQDNTLPYT

SEQ ID NO: 325 - protein, 6 aa, Artificial Sequence
  Description of Artificial Sequence: Synthetic peptide
TNYWMH

SEQ ID NO: 326 - protein, 13 aa, Artificial Sequence
  Description of Artificial Sequence: Synthetic peptide
WIGNIDPSDSETH

SEQ ID NO: 327 - protein, 9 aa, Artificial Sequence
  Description of Artificial Sequence: Synthetic peptide
ASGLTGTGY

SEQ ID NO: 328 - protein, 7 aa, Artificial Sequence
  Description of Artificial Sequence: Synthetic peptide
RPYLNWY

SEQ ID NO: 329 - protein, 10 aa, Artificial Sequence
  Description of Artificial Sequence: Synthetic peptide
LLIYFTSKLH

SEQ ID NO: 330 - protein, 8 aa, Artificial Sequence
  Description of Artificial Sequence: Synthetic peptide
QQDNTLPY

SEQ ID NO: 331 - protein, 8 aa, Artificial Sequence
  Description of Artificial Sequence: Synthetic peptide
GYTFTNYW

SEQ ID NO: 332 - protein, 8 aa, Artificial Sequence
  Description of Artificial Sequence: Synthetic peptide
IDPSDSET

SEQ ID NO: 333 - protein, 10 aa, Artificial Sequence
  Description of Artificial Sequence: Synthetic peptide
ASGLTGTGYY

SEQ ID NO: 334 - protein, 6 aa, Artificial Sequence
  Description of Artificial Sequence: Synthetic peptide
QDIRPY

SEQ ID NO: 335 - protein, 3 aa, Artificial Sequence
  Description of Artificial Sequence: Synthetic peptide
FTS

SEQ ID NO: 336 - protein, 9 aa, Artificial Sequence
  Description of Artificial Sequence: Synthetic peptide
QQDNTLPYT

SEQ ID NO: 337 - protein, 117 aa, Artificial Sequence
  Description of Artificial Sequence: Synthetic polypeptide
QVQLQQPGAELVKPGASVMLSCKASGYTFTNYWMHWVKQRPGQGLEWIGNIDPSDSETHYNQKFKDKATLTVDKSSSTAYMQLSSLTSEDSAVYYCASGLTGTGYYWGQGTTLTVSS

SEQ ID NO: 338 - protein, 107 aa, Artificial Sequence
  Description of Artificial Sequence: Synthetic polypeptide
DIQMTQTTSSLSASLGDRVTITCRASQDIRPYLNWYQQKPEGTIKLLIYFTSKLHSGVPSRFSGSGSGTDYSLTISNLEQEDIATYFCQQDNTLPYTFGSGTKLELK

SEQ ID NO: 339 - protein, 447 aa, Artificial Sequence
  Description of Artificial Sequence: Synthetic polypeptide
QVQLQQPGAELVKPGASVMLSCKASGYTFTNYWMHWVKQRPGQGLEWIGNIDPSDSETHYNQKFKDKATLTVDKSSSTAYMQLSSLTSEDSAVYYCASGLTGTGYYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 340 - protein, 214 aa, Artificial Sequence
  Description of Artificial Sequence: Synthetic polypeptide
DIQMTQTTSSLSASLGDRVTITCRASQDIRPYLNWYQQKPEGTIKLLIYFTSKLHSGVPSRFSGSGSGTDYSLTISNLEQEDIATYFCQQDNTLPYTFGSGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 341 - protein, 5 aa, Artificial Sequence
  Description of Artificial Sequence: Synthetic peptide
DYYMD

SEQ ID NO: 342 - protein, 17 aa, Artificial Sequence
  Description of Artificial Sequence: Synthetic peptide
YIYPNNGITSYNQKFKG

SEQ ID NO: 343 - protein, 12 aa, Artificial Sequence
  Description of Artificial Sequence: Synthetic peptide
SIYYDHGGGFPY

SEQ ID NO: 344 - protein, 11 aa, Artificial Sequence
  Description of Artificial Sequence: Synthetic peptide
KASQNVDKYVA

SEQ ID NO: 345 - protein, 7 aa, Artificial Sequence
  Description of Artificial Sequence: Synthetic peptide
SASYRYS

SEQ ID NO: 346 - protein, 8 aa, Artificial Sequence
  Description of Artificial Sequence: Synthetic peptide
QQYNTYPS

SEQ ID NO: 347 - protein, 7 aa, Artificial Sequence
  Description of Artificial Sequence: Synthetic peptide
GYIFTDY

SEQ ID NO: 348 - protein, 6 aa, Artificial Sequence
  Description of Artificial Sequence: Synthetic peptide
YPNNGI

SEQ ID NO: 349 - protein, 11 aa, Artificial Sequence
  Description of Artificial Sequence: Synthetic peptide
SIYYDHGGGFP

SEQ ID NO: 350 - protein, 7 aa, Artificial Sequence
  Description of Artificial Sequence: Synthetic peptide
SQNVDKY

SEQ ID NO: 351 - protein, 3 aa, Artificial Sequence
  Description of Artificial Sequence: Synthetic peptide
SAS

SEQ ID NO: 352 - protein, 5 aa, Artificial Sequence
  Description of Artificial Sequence: Synthetic peptide
YNTYP

SEQ ID NO: 353 - protein, 10 aa, Artificial Sequence
  Description of Artificial Sequence: Synthetic peptide
GYIFTDYYMD

SEQ ID NO: 354 - protein, 10 aa, Artificial Sequence
  Description of Artificial Sequence: Synthetic peptide
YIYPNNGITS

SEQ ID NO: 355 - protein, 12 aa, Artificial Sequence
  Description of Artificial Sequence: Synthetic peptide
SIYYDHGGGFPY

SEQ ID NO: 356 - protein, 11 aa, Artificial Sequence
  Description of Artificial Sequence: Synthetic peptide
KASQNVDKYVA

SEQ ID NO: 357 - protein, 7 aa, Artificial Sequence
  Description of Artificial Sequence: Synthetic peptide
SASYRYS

SEQ ID NO: 358 - protein, 8 aa, Artificial Sequence
  Description of Artificial Sequence: Synthetic peptide
QQYNTYPS

SEQ ID NO: 359 - protein, 6 aa, Artificial Sequence
  Description of Artificial Sequence: Synthetic peptide
TDYYMD

SEQ ID NO: 360 - protein, 13 aa, Artificial Sequence
  Description of Artificial Sequence: Synthetic peptide
WIGYIYPNNGITS

SEQ ID NO: 361 - protein, 13 aa, Artificial Sequence
  Description of Artificial Sequence: Synthetic peptide
ARSIYYDHGGGFP

SEQ ID NO: 362 - protein, 7 aa, Artificial Sequence
  Description of Artificial Sequence: Synthetic peptide
DKYVAWY

SEQ ID NO: 363 - protein, 10 aa, Artificial Sequence
  Description of Artificial Sequence: Synthetic peptide
ALIYSASYRY

SEQ ID NO: 364 - protein, 7 aa, Artificial Sequence
  Description of Artificial Sequence: Synthetic peptide
QQYNTYP

SEQ ID NO: 365 - protein, 8 aa, Artificial Sequence
  Description of Artificial Sequence: Synthetic peptide
GYIFTDYY

SEQ ID NO: 366 - protein, 8 aa, Artificial Sequence
  Description of Artificial Sequence: Synthetic peptide
IYPNNGIT

SEQ ID NO: 367 - protein, 14 aa, Artificial Sequence
  Description of Artificial Sequence: Synthetic peptide
ARSIYYDHGGGFPY

SEQ ID NO: 368 - protein, 6 aa, Artificial Sequence
  Description of Artificial Sequence: Synthetic peptide
QNVDKY

SEQ ID NO: 369 - protein, 3 aa, Artificial Sequence
  Description of Artificial Sequence: Synthetic peptide
SAS

SEQ ID NO: 370 - protein, 8 aa, Artificial Sequence
  Description of Artificial Sequence: Synthetic peptide
QQYNTYPS

SEQ ID NO: 371 - protein, 121 aa, Artificial Sequence
  Description of Artificial Sequence: Synthetic polypeptide
EVQLQQSGPELVKPGDSMKMSCKASGYIFTDYYMDWVKQSHGKSLEWIGYIYPNNGITSYNQKFKGRATLTIDKSSSTAYMELHSLTSEDSAVYYCARSIYYDHGGGFPYWGQGTSVTVSS

SEQ ID NO: 372 - protein, 106 aa, Artificial Sequence
  Description of Artificial Sequence: Synthetic polypeptide
DIVLTQSQKFMSTSVGDRVSVTCKASQNVDKYVAWYQQKPGQSPKALIYSASYRYSGVPDRFTGSGSGTDFTLTISNVQSEDLAEYFCQQYNTYPSFGSGTKLEMK

SEQ ID NO: 373 - protein, 451 aa, Artificial Sequence
  Description of Artificial Sequence: Synthetic polypeptide
EVQLQQSGPELVKPGDSMKMSCKASGYIFTDYYMDWVKQSHGKSLEWIGYIYPNNGITSYNQKFKGRATLTIDKSSSTAYMELHSLTSEDSAVYYCARSIYYDHGGGFPYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 374 - protein, 213 aa, Artificial Sequence
  Description of Artificial Sequence: Synthetic polypeptide
DIVLTQSQKFMSTSVGDRVSVTCKASQNVDKYVAWYQQKPGQSPKALIYSASYRYSGVPDRFTGSGSGTDFTLTISNVQSEDLAEYFCQQYNTYPSFGSGTKLEMKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 375 - protein, 5 aa, Artificial Sequence
  Description of Artificial Sequence: Synthetic peptide
DYYMN

SEQ ID NO: 376 - protein, 17 aa, Artificial Sequence
  Description of Artificial Sequence: Synthetic peptide
RVIPSNGGTIYNLKFKG

SEQ ID NO: 377 - protein, 15 aa, Artificial Sequence
  Description of Artificial Sequence: Synthetic peptide
EDYNNQGFFLDAMDY

SEQ ID NO: 378 - protein, 11 aa, Artificial Sequence
  Description of Artificial Sequence: Synthetic peptide
RASQSISDFLH

SEQ ID NO: 379 - protein, 7 aa, Artificial Sequence
  Description of Artificial Sequence: Synthetic peptide
YASQSIS

SEQ ID NO: 380 - protein, 9 aa, Artificial Sequence
  Description of Artificial Sequence: Synthetic peptide
QNGHSFPYT

SEQ ID NO: 381 - protein, 7 aa, Artificial Sequence
  Description of Artificial Sequence: Synthetic peptide
GYTFTDY

SEQ ID NO: 382 - protein, 6 aa, Artificial Sequence
  Description of Artificial Sequence: Synthetic peptide
IPSNGG

SEQ ID NO: 383 - protein, 14 aa, Artificial Sequence
  Description of Artificial Sequence: Synthetic peptide
EDYNNQGFFLDAMD

SEQ ID NO: 384 - protein, 7 aa, Artificial Sequence
  Description of Artificial Sequence: Synthetic peptide
SQSISDF

SEQ ID NO: 385 - protein, 3 aa, Artificial Sequence
  Description of Artificial Sequence: Synthetic peptide
YAS

SEQ ID NO: 386 - protein, 6 aa, Artificial Sequence
  Description of Artificial Sequence: Synthetic peptide
GHSFPY

SEQ ID NO: 387 - protein, 10 aa, Artificial Sequence
  Description of Artificial Sequence: Synthetic peptide
GYTFTDYYMN

SEQ ID NO: 388 - protein, 10 aa, Artificial Sequence
  Description of Artificial Sequence: Synthetic peptide
RVIPSNGGTI

SEQ ID NO: 389 - protein, 15 aa, Artificial Sequence
  Description of Artificial Sequence: Synthetic peptide
EDYNNQGFFLDAMDY

SEQ ID NO: 390 - protein, 11 aa, Artificial Sequence
  Description of Artificial Sequence: Synthetic peptide
RASQSISDFLH

SEQ ID NO: 391 - protein, 7 aa, Artificial Sequence
  Description of Artificial Sequence: Synthetic peptide
YASQSIS

SEQ ID NO: 392 - protein, 9 aa, Artificial Sequence
  Description of Artificial Sequence: Synthetic peptide
QNGHSFPYT

SEQ ID NO: 393 - protein, 6 aa, Artificial Sequence
  Description of Artificial Sequence: Synthetic peptide
TDYYMN

SEQ ID NO: 394 - protein, 13 aa, Artificial Sequence
  Description of Artificial Sequence: Synthetic peptide
WIGRVIPSNGGTI

SEQ ID NO: 395 - protein, 16 aa, Artificial Sequence
  Description of Artificial Sequence: Synthetic peptide
AREDYNNQGFFLDAMD

SEQ ID NO: 396 - protein, 7 aa, Artificial Sequence
  Description of Artificial Sequence: Synthetic peptide
SDFLHWY

SEQ ID NO: 397 - protein, 10 aa, Artificial Sequence
  Description of Artificial Sequence: Synthetic peptide
LLIKYASQSI

SEQ ID NO: 398 - protein, 8 aa, Artificial Sequence
  Description of Artificial Sequence: Synthetic peptide
QNGHSFPY

SEQ ID NO: 399 - protein, 8 aa, Artificial Sequence
  Description of Artificial Sequence: Synthetic peptide
GYTFTDYY

SEQ ID NO: 400 - protein, 8 aa, Artificial Sequence
  Description of Artificial Sequence: Synthetic peptide
VIPSNGGT

SEQ ID NO: 401 - protein, 17 aa, Artificial Sequence
  Description of Artificial Sequence: Synthetic peptide
AREDYNNQGFFLDAMDY

SEQ ID NO: 402 - protein, 6 aa, Artificial Sequence
  Description of Artificial Sequence: Synthetic peptide
QSISDF

SEQ ID NO: 403 - protein, 3 aa, Artificial Sequence
  Description of Artificial Sequence: Synthetic peptide
YAS

SEQ ID NO: 404 - protein, 9 aa, Artificial Sequence
  Description of Artificial Sequence: Synthetic peptide
QNGHSFPYT

SEQ ID NO: 405 - protein, 124 aa, Artificial Sequence
  Description of Artificial Sequence: Synthetic polypeptide
QVQLQQSGPELVKPGTSVKMSCKASGYTFTDYYMNWVKQSHGKSLEWIGRVIPSNGGTIYNLKFKGKATLTVDKSLSTAYMQLNSLTSEDSAVYFCAREDYNNQGFFLDAMDYWGQGTLVTVSA

SEQ ID NO: 406 - protein, 107 aa, Artificial Sequence
  Description of Artificial Sequence: Synthetic polypeptide
DIVMTQSPATLSVTPGDRVSLSCRASQSISDFLHWYQQKSHESPRLLIKYASQSISGIPSRFSGSGSGSDFTLTINSVEPEDVGVYYCQNGHSFPYTFGSGTKLEIK

SEQ ID NO: 407 - protein, 454 aa, Artificial Sequence
  Description of Artificial Sequence: Synthetic polypeptide
QVQLQQSGPELVKPGTSVKMSCKASGYTFTDYYMNWVKQSHGKSLEWIGRVIPSNGGTIYNLKFKGKATLTVDKSLSTAYMQLNSLTSEDSAVYFCAREDYNNQGFFLDAMDYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 408 - protein, 214 aa, Artificial Sequence
  Description of Artificial Sequence: Synthetic polypeptide
DIVMTQSPATLSVTPGDRVSLSCRASQSISDFLHWYQQKSHESPRLLIKYASQSISGIPSRFSGSGSGSDFTLTINSVEPEDVGVYYCQNGHSFPYTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 409 - protein, 5 aa, Artificial Sequence
  Description of Artificial Sequence: Synthetic peptide
DYYMD

SEQ ID NO: 410 - protein, 17 aa, Artificial Sequence
  Description of Artificial Sequence: Synthetic peptide
YIYPNNGDTRYNQKFKD

SEQ ID NO: 411 - protein, 12 aa, Artificial Sequence
  Description of Artificial Sequence: Synthetic peptide
SIYYDHGGGFPY

SEQ ID NO: 412 - protein, 11 aa, Artificial Sequence
  Description of Artificial Sequence: Synthetic peptide
KASQNVGTYVA

SEQ ID NO: 413 - protein, 7 aa, Artificial Sequence
  Description of Artificial Sequence: Synthetic peptide
SASYRYS

SEQ ID NO: 414 - protein, 8 aa, Artificial Sequence
  Description of Artificial Sequence: Synthetic peptide
QQYNSYPT

SEQ ID NO: 415 - protein, 7 aa, Artificial Sequence
  Description of Artificial Sequence: Synthetic peptide
GYTFTDY

SEQ ID NO: 416 - protein, 6 aa, Artificial Sequence
  Description of Artificial Sequence: Synthetic peptide
YPNNGD

SEQ ID NO: 417 - protein, 11 aa, Artificial Sequence
  Description of Artificial Sequence: Synthetic peptide
SIYYDHGGGFP

SEQ ID NO: 418 - protein, 7 aa, Artificial Sequence
  Description of Artificial Sequence: Synthetic peptide
SQNVGTY

SEQ ID NO: 419 - protein, 3 aa, Artificial Sequence
  Description of Artificial Sequence: Synthetic peptide
SAS

SEQ ID NO: 420 - protein, 5 aa, Artificial Sequence
  Description of Artificial Sequence: Synthetic peptide
YNSYP

SEQ ID NO: 421 - protein, 10 aa, Artificial Sequence
  Description of Artificial Sequence: Synthetic peptide
GYTFTDYYMD

SEQ ID NO: 422 - protein, 10 aa, Artificial Sequence
  Description of Artificial Sequence: Synthetic peptide
YIYPNNGDTR

SEQ ID NO: 423 - protein, 12 aa, Artificial Sequence
  Description of Artificial Sequence: Synthetic peptide
SIYYDHGGGFPY

SEQ ID NO: 424 - protein, 11 aa, Artificial Sequence
  Description of Artificial Sequence: Synthetic peptide
KASQNVGTYVA

SEQ ID NO: 425 - protein, 7 aa, Artificial Sequence
  Description of Artificial Sequence: Synthetic peptide
SASYRYS

SEQ ID NO: 426 - protein, 8 aa, Artificial Sequence
  Description of Artificial Sequence: Synthetic peptide
QQYNSYPT

SEQ ID NO: 427 - protein, 6 aa, Artificial Sequence
  Description of Artificial Sequence: Synthetic peptide
TDYYMD

SEQ ID NO: 428 - protein, 13 aa, Artificial Sequence
  Description of Artificial Sequence: Synthetic peptide
WIGYIYPNNGDTR

SEQ ID NO: 429 - protein, 13 aa, Artificial Sequence
  Description of Artificial Sequence: Synthetic peptide
ARSIYYDHGGGFP

SEQ ID NO: 430 - protein, 7 aa, Artificial Sequence
  Description of Artificial Sequence: Synthetic peptide
GTYVAWY

SEQ ID NO: 431 - protein, 10 aa, Artificial Sequence
  Description of Artificial Sequence: Synthetic peptide
ALIYSASYRY

SEQ ID NO: 432 - protein, 7 aa, Artificial Sequence
  Description of Artificial Sequence: Synthetic peptide
QQYNSYP

SEQ ID NO: 433 - protein, 8 aa, Artificial Sequence
  Description of Artificial Sequence: Synthetic peptide
GYTFTDYY

SEQ ID NO: 434 - protein, 8 aa, Artificial Sequence
  Description of Artificial Sequence: Synthetic peptide
IYPNNGDT

SEQ ID NO: 435 - protein, 14 aa, Artificial Sequence
  Description of Artificial Sequence: Synthetic peptide
ARSIYYDHGGGFPY

SEQ ID NO: 436 - protein, 6 aa, Artificial Sequence
  Description of Artificial Sequence: Synthetic peptide
QNVGTY

SEQ ID NO: 437 - protein, 3 aa, Artificial Sequence
  Description of Artificial Sequence: Synthetic peptide
SAS

SEQ ID NO: 438 - protein, 8 aa, Artificial Sequence
  Description of Artificial Sequence: Synthetic peptide
QQYNSYPT

SEQ ID NO: 439 - protein, 121 aa, Artificial Sequence
  Description of Artificial Sequence: Synthetic polypeptide
EVQLQQSGPELVKPGNSVKMSCKASGYTFTDYYMDWVKQSHGTSLEWIGYIYPNNGDTRYNQKFKDKATLTVDKSSSTAYMELHSLTSEDSAVFYCARSIYYDHGGGFPYWGQGTLVTVSA

SEQ ID NO: 440 - protein, 106 aa, Artificial Sequence
  Description of Artificial Sequence: Synthetic polypeptide
DIVMTQSQKFMSTSVGDRVSVTCKASQNVGTYVAWYQQKPGQSPKALIYSASYRYSGVPDRFTGSGSGTDFTLTINNVQSEDLAEYLCQQYNSYPTFGGGTRLEIK

SEQ ID NO: 441 - protein, 451 aa, Artificial Sequence
  Description of Artificial Sequence: Synthetic polypeptide
EVQLQQSGPELVKPGNSVKMSCKASGYTFTDYYMDWVKQSHGTSLEWIGYIYPNNGDTRYNQKFKDKATLTVDKSSSTAYMELHSLTSEDSAVFYCARSIYYDHGGGFPYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 442 - protein, 213 aa, Artificial Sequence
  Description of Artificial Sequence: Synthetic polypeptide
DIVMTQSQKFMSTSVGDRVSVTCKASQNVGTYVAWYQQKPGQSPKALIYSASYRYSGVPDRFTGSGSGTDFTLTINNVQSEDLAEYLCQQYNSYPTFGGGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 443 - protein, 7 aa, Artificial Sequence
  Description of Artificial Sequence: Synthetic peptide
TSGMNVG

SEQ ID NO: 444 - protein, 16 aa, Artificial Sequence
  Description of Artificial Sequence: Synthetic peptide
HIWWDDDKYYNPSLKS

SEQ ID NO: 445 - protein, 11 aa, Artificial Sequence
  Description of Artificial Sequence: Synthetic peptide
RGNYGNYEFAY

SEQ ID NO: 446 - protein, 11 aa, Artificial Sequence
  Description of Artificial Sequence: Synthetic peptide
RASQDIRNYLN

SEQ ID NO: 447 - protein, 7 aa, Artificial Sequence
  Description of Artificial Sequence: Synthetic peptide
HTSRLHS

SEQ ID NO: 448 - protein, 9 aa, Artificial Sequence
  Description of Artificial Sequence: Synthetic peptide
QQGNTLPWT

SEQ ID NO: 449 - protein, 9 aa, Artificial Sequence
  Description of Artificial Sequence: Synthetic peptide
GFSLSTSGM

SEQ ID NO: 450 - protein, 5 aa, Artificial Sequence
  Description of Artificial Sequence: Synthetic peptide
WWDDD

SEQ ID NO: 451 - protein, 10 aa, Artificial Sequence
  Description of Artificial Sequence: Synthetic peptide
RGNYGNYEFA

SEQ ID NO: 452 - protein, 7 aa, Artificial Sequence
  Description of Artificial Sequence: Synthetic peptide
SQDIRNY

SEQ ID NO: 453 - protein, 3 aa, Artificial Sequence
  Description of Artificial Sequence: Synthetic peptide
HTS

SEQ ID NO: 454 - protein, 6 aa, Artificial Sequence
  Description of Artificial Sequence: Synthetic peptide
GNTLPW

SEQ ID NO: 455 - protein, 12 aa, Artificial Sequence
  Description of Artificial Sequence: Synthetic peptide
GFSLSTSGMNVG

SEQ ID NO: 456 - protein, 9 aa, Artificial Sequence
  Description of Artificial Sequence: Synthetic peptide
HIWWDDDKY

SEQ ID NO: 457 - protein, 11 aa, Artificial Sequence
  Description of Artificial Sequence: Synthetic peptide
RGNYGNYEFAY

SEQ ID NO: 458 - protein, 11 aa, Artificial Sequence
  Description of Artificial Sequence: Synthetic peptide
RASQDIRNYLN

SEQ ID NO: 459 - protein, 7 aa, Artificial Sequence
  Description of Artificial Sequence: Synthetic peptide
HTSRLHS

SEQ ID NO: 460 - protein, 9 aa, Artificial Sequence
  Description of Artificial Sequence: Synthetic peptide
QQGNTLPWT

SEQ ID NO: 461 - protein, 8 aa, Artificial Sequence
  Description of Artificial Sequence: Synthetic peptide
STSGMNVG

SEQ ID NO: 462 - protein, 12 aa, Artificial Sequence
  Description of Artificial Sequence: Synthetic peptide
WLAHIWWDDDKY

SEQ ID NO: 463 - protein, 12 aa, Artificial Sequence
  Description of Artificial Sequence: Synthetic peptide
ARRGNYGNYEFA

SEQ ID NO: 464 - protein, 7 aa, Artificial Sequence
  Description of Artificial Sequence: Synthetic peptide
RNYLNWY

SEQ ID NO: 465 - protein, 10 aa, Artificial Sequence
  Description of Artificial Sequence: Synthetic peptide
LLIYHTSRLH

SEQ ID NO: 466 - protein, 8 aa, Artificial Sequence
  Description of Artificial Sequence: Synthetic peptide
QQGNTLPW

SEQ ID NO: 467 - protein, 10 aa, Artificial Sequence
  Description of Artificial Sequence: Synthetic peptide
GFSLSTSGMN

SEQ ID NO: 468 - protein, 7 aa, Artificial Sequence
  Description of Artificial Sequence: Synthetic peptide
IWWDDDK

SEQ ID NO: 469 - protein, 13 aa, Artificial Sequence
  Description of Artificial Sequence: Synthetic peptide
ARRGNYGNYEFAY

SEQ ID NO: 470 - protein, 6 aa, Artificial Sequence
  Description of Artificial Sequence: Synthetic peptide
QDIRNY

SEQ ID NO: 471 - protein, 3 aa, Artificial Sequence
  Description of Artificial Sequence: Synthetic peptide
HTS

SEQ ID NO: 472 - protein, 9 aa, Artificial Sequence
  Description of Artificial Sequence: Synthetic peptide
QQGNTLPWT

SEQ ID NO: 473 - protein, 121 aa, Artificial Sequence
  Description of Artificial Sequence: Synthetic polypeptide
QVQLKESGPGILKPSQTLSLTCSFSGFSLSTSGMNVGWIRQPSGKGLEWLAHIWWDDDKYYNPSLKSQLTISKDTSRNQVFLKITSVDTADTATYYCARRGNYGNYEFAYWGQGTTLTVSS

SEQ ID NO: 474 - protein, 107 aa, Artificial Sequence
  Description of Artificial Sequence: Synthetic polypeptide
DIQMTQTTSSLSASLGDRVTISCRASQDIRNYLNWYQQKPDGTVKLLIYHTSRLHSGVPSRFSGSGSGTDYSLTISNLEQEDIATYFCQQGNTLPWTFGAGTKLELK

SEQ ID NO: 475 - protein, 451 aa, Artificial Sequence
  Description of Artificial Sequence: Synthetic polypeptide
QVQLKESGPGILKPSQTLSLTCSFSGFSLSTSGMNVGWIRQPSGKGLEWLAHIWWDDDKYYNPSLKSQLTISKDTSRNQVFLKITSVDTADTATYYCARRGNYGNYEFAYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 476 - protein, 214 aa, Artificial Sequence
  Description of Artificial Sequence: Synthetic polypeptide
DIQMTQTTSSLSASLGDRVTISCRASQDIRNYLNWYQQKPDGTVKLLIYHTSRLHSGVPSRFSGSGSGTDYSLTISNLEQEDIATYFCQQGNTLPWTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 477 - protein, 5 aa, Artificial Sequence
  Description of Artificial Sequence: Synthetic peptide
VYTIH

SEQ ID NO: 478 - protein, 17 aa, Artificial Sequence
  Description of Artificial Sequence: Synthetic peptide
WFYPGSGNIKYNEKFKD

SEQ ID NO: 479 - protein, 15 aa, Artificial Sequence
  Description of Artificial Sequence: Synthetic peptide
HEDNHYYDGNSWFAY

SEQ ID NO: 480 - protein, 11 aa, Artificial Sequence
  Description of Artificial Sequence: Synthetic peptide
RASGNIHNYLA

SEQ ID NO: 481 - protein, 7 aa, Artificial Sequence
  Description of Artificial Sequence: Synthetic peptide
NAKTLAD

SEQ ID NO: 482 - protein, 9 aa, Artificial Sequence
  Description of Artificial Sequence: Synthetic peptide
QHFWNTPYT

SEQ ID NO: 483 - protein, 7 aa, Artificial Sequence
  Description of Artificial Sequence: Synthetic peptide
GYTFTVY

SEQ ID NO: 484 - protein, 6 aa, Artificial Sequence
  Description of Artificial Sequence: Synthetic peptide
YPGSGN

SEQ ID NO: 485 - protein, 14 aa, Artificial Sequence
  Description of Artificial Sequence: Synthetic peptide
HEDNHYYDGNSWFA

SEQ ID NO: 486 - protein, 7 aa, Artificial Sequence
  Description of Artificial Sequence: Synthetic peptide
SGNIHNY

SEQ ID NO: 487 - protein, 3 aa, Artificial Sequence
  Description of Artificial Sequence: Synthetic peptide
NAK

SEQ ID NO: 488 - protein, 6 aa, Artificial Sequence
  Description of Artificial Sequence: Synthetic peptide
FWNTPY

SEQ ID NO: 489 - protein, 10 aa, Artificial Sequence
  Description of Artificial Sequence: Synthetic peptide
GYTFTVYTIH

SEQ ID NO: 490 - protein, 10 aa, Artificial Sequence
  Description of Artificial Sequence: Synthetic peptide
WFYPGSGNIK

SEQ ID NO: 491 - protein, 15 aa, Artificial Sequence
  Description of Artificial Sequence: Synthetic peptide
HEDNHYYDGNSWFAY

SEQ ID NO: 492 - protein, 11 aa, Artificial Sequence
  Description of Artificial Sequence: Synthetic peptide
RASGNIHNYLA

SEQ ID NO: 493 - protein, 7 aa, Artificial Sequence
  Description of Artificial Sequence: Synthetic peptide
NAKTLAD

SEQ ID NO: 494 - protein, 9 aa, Artificial Sequence
  Description of Artificial Sequence: Synthetic peptide
QHFWNTPYT

SEQ ID NO: 495 - protein, 6 aa, Artificial Sequence
  Description of Artificial Sequence: Synthetic peptide
TVYTIH

SEQ ID NO: 496 - protein, 13 aa, Artificial Sequence
  Description of Artificial Sequence: Synthetic peptide
WIGWFYPGSGNIK

SEQ ID NO: 497 - protein, 16 aa, Artificial Sequence
  Description of Artificial Sequence: Synthetic peptide
ARHEDNHYYDGNSWFA

SEQ ID NO: 498 - protein, 7 aa, Artificial Sequence
  Description of Artificial Sequence: Synthetic peptide
HNYLAWF

SEQ ID NO: 499 - protein, 10 aa, Artificial Sequence
  Description of Artificial Sequence: Synthetic peptide
LLVYNAKTLA

SEQ ID NO: 500 - protein, 8 aa, Artificial Sequence
  Description of Artificial Sequence: Synthetic peptide
QHFWNTPY

SEQ ID NO: 501 - protein, 8 aa, Artificial Sequence
  Description of Artificial Sequence: Synthetic peptide
GYTFTVYT

SEQ ID NO: 502 - protein, 8 aa, Artificial Sequence
  Description of Artificial Sequence: Synthetic peptide
FYPGSGNI

SEQ ID NO: 503 - protein, 17 aa, Artificial Sequence
  Description of Artificial Sequence: Synthetic peptide
ARHEDNHYYDGNSWFAY

SEQ ID NO: 504 - protein, 6 aa, Artificial Sequence
  Description of Artificial Sequence: Synthetic peptide
GNIHNY

SEQ ID NO: 505 - protein, 3 aa, Artificial Sequence
  Description of Artificial Sequence: Synthetic peptide
NAK

SEQ ID NO: 506 - protein, 9 aa, Artificial Sequence
  Description of Artificial Sequence: Synthetic peptide
QHFWNTPYT

SEQ ID NO: 507 - protein, 124 aa, Artificial Sequence
  Description of Artificial Sequence: Synthetic polypeptide
QVQLQQSGAELVKPGASVKLSCKASGYTFTVYTIHWVKQRSGQGLEWIGWFYPGSGNIKYNEKFKDKATLTADKSSHTVYMELSRLTSEDSAVYFCARHEDNHYYDGNSWFAYWGQGTLVTVSA

SEQ ID NO: 508 - protein, 107 aa, Artificial Sequence
  Description of Artificial Sequence: Synthetic polypeptide
DIQMTQSPASLSASVGQTVTITCRASGNIHNYLAWFQQKQGKSPQLLVYNAKTLADGVPSRFSGSGSGTQYSLKINSLQTEDFGNYYCQHFWNTPYTFGGGTKLEIK

SEQ ID NO: 509 - protein, 454 aa, Artificial Sequence
  Description of Artificial Sequence: Synthetic polypeptide
QVQLQQSGAELVKPGASVKLSCKASGYTFTVYTIHWVKQRSGQGLEWIGWFYPGSGNIKYNEKFKDKATLTADKSSHTVYMELSRLTSEDSAVYFCARHEDNHYYDGNSWFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 510 - protein, 214 aa, Artificial Sequence
  Description of Artificial Sequence: Synthetic polypeptide
DIQMTQSPASLSASVGQTVTITCRASGNIHNYLAWFQQKQGKSPQLLVYNAKTLADGVPSRFSGSGSGTQYSLKINSLQTEDFGNYYCQHFWNTPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 511 - protein, 5 aa, Artificial Sequence
  Description of Artificial Sequence: Synthetic peptide
IYSIH

SEQ ID NO: 512 - protein, 16 aa, Artificial Sequence
  Description of Artificial Sequence: Synthetic peptide
MIWGGGDTDYNSALKS

SEQ ID NO: 513 - protein, 14 aa, Artificial Sequence
  Description of Artificial Sequence: Synthetic peptide
NPHYYGGTYEYFDV

SEQ ID NO: 514 - protein, 11 aa, Artificial Sequence
  Description of Artificial Sequence: Synthetic peptide
SASQGISNYLN

SEQ ID NO: 515 - protein, 7 aa, Artificial Sequence
  Description of Artificial Sequence: Synthetic peptide
DTSILYS

SEQ ID NO: 516 - protein, 9 aa, Artificial Sequence
  Description of Artificial Sequence: Synthetic peptide
QQYSNLPYT

SEQ ID NO: 517 - protein, 7 aa, Artificial Sequence
  Description of Artificial Sequence: Synthetic peptide
GFSLSIY

SEQ ID NO: 518 - protein, 5 aa, Artificial Sequence
  Description of Artificial Sequence: Synthetic peptide
WGGGD

SEQ ID NO: 519 - protein, 13 aa, Artificial Sequence
  Description of Artificial Sequence: Synthetic peptide
NPHYYGGTYEYFD

SEQ ID NO: 520 - protein, 7 aa, Artificial Sequence
  Description of Artificial Sequence: Synthetic peptide
SQGISNY

SEQ ID NO: 521 - protein, 3 aa, Artificial Sequence
  Description of Artificial Sequence: Synthetic peptide
DTS

SEQ ID NO: 522 - protein, 6 aa, Artificial Sequence
  Description of Artificial Sequence: Synthetic peptide
YSNLPY

SEQ ID NO: 523 - protein, 10 aa, Artificial Sequence
  Description of Artificial Sequence: Synthetic peptide
GFSLSIYSIH

SEQ ID NO: 524 - protein, 9 aa, Artificial Sequence
  Description of Artificial Sequence: Synthetic peptide
MIWGGGDTD

SEQ ID NO: 525 - protein, 14 aa, Artificial Sequence
  Description of Artificial Sequence: Synthetic peptide
NPHYYGGTYEYFDV

SEQ ID NO: 526 - protein, 11 aa, Artificial Sequence
  Description of Artificial Sequence: Synthetic peptide
SASQGISNYLN

SEQ ID NO: 527 - protein, 7 aa, Artificial Sequence
  Description of Artificial Sequence: Synthetic peptide
DTSILYS

SEQ ID NO: 528 - protein, 9 aa, Artificial Sequence
  Description of Artificial Sequence: Synthetic peptide
QQYSNLPYT

SEQ ID NO: 529 - protein, 6 aa, Artificial Sequence
  Description of Artificial Sequence: Synthetic peptide
SIYSIH

SEQ ID NO: 530 - protein, 12 aa, Artificial Sequence
  Description of Artificial Sequence: Synthetic peptide
WLGMIWGGGDTD

SEQ ID NO: 531 - protein, 15 aa, Artificial Sequence
  Description of Artificial Sequence: Synthetic peptide
ARNPHYYGGTYEYFD

SEQ ID NO: 532 - protein, 7 aa, Artificial Sequence
  Description of Artificial Sequence: Synthetic peptide
SNYLNWY

SEQ ID NO: 533 - protein, 10 aa, Artificial Sequence
  Description of Artificial Sequence: Synthetic peptide
LLIYDTSILY

SEQ ID NO: 534 - protein, 8 aa, Artificial Sequence
  Description of Artificial Sequence: Synthetic peptide
QQYSNLPY

SEQ ID NO: 535 - protein, 8 aa, Artificial Sequence
  Description of Artificial Sequence: Synthetic peptide
GFSLSIYS

SEQ ID NO: 536 - protein, 7 aa, Artificial Sequence
  Description of Artificial Sequence: Synthetic peptide
IWGGGDT

SEQ ID NO: 537 - protein, 16 aa, Artificial Sequence
  Description of Artificial Sequence: Synthetic peptide
ARNPHYYGGTYEYFDV

SEQ ID NO: 538 - protein, 6 aa, Artificial Sequence
  Description of Artificial Sequence: Synthetic peptide
QGISNY

SEQ ID NO: 539 - protein, 3 aa, Artificial Sequence
  Description of Artificial Sequence: Synthetic peptide
DTS

SEQ ID NO: 540 - protein, 9 aa, Artificial Sequence
  Description of Artificial Sequence: Synthetic peptide
QQYSNLPYT

SEQ ID NO: 541 - protein, 122 aa, Artificial Sequence
  Description of Artificial Sequence: Synthetic polypeptide
DVQLQESGPGLVAPSQSLSITCTVSGFSLSIYSIHWVRQPPGKGLEWLGMIWGGGDTDYNSALKSRLSISKDNSESQVFLKMNSLQTDDTAMYYCARNPHYYGGTYEYFDVWGTGTTVTVSS

SEQ ID NO: 542 - protein, 107 aa, Artificial Sequence
  Description of Artificial Sequence: Synthetic polypeptide
DIQMTQTTSSLSASLGDRVTISCSASQGISNYLNWYQQKPDGTVKLLIYDTSILYSGVPSRFSGSGSGTDYSLTISNLEPEDVATYYCQQYSNLPYTFGSGTKLEIK

SEQ ID NO: 543 - protein, 452 aa, Artificial Sequence
  Description of Artificial Sequence: Synthetic polypeptide
DVQLQESGPGLVAPSQSLSITCTVSGFSLSIYSIHWVRQPPGKGLEWLGMIWGGGDTDYNSALKSRLSISKDNSESQVFLKMNSLQTDDTAMYYCARNPHYYGGTYEYFDVWGTGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 544 - protein, 214 aa, Artificial Sequence
  Description of Artificial Sequence: Synthetic polypeptide
DIQMTQTTSSLSASLGDRVTISCSASQGISNYLNWYQQKPDGTVKLLIYDTSILYSGVPSRFSGSGSGTDYSLTISNLEPEDVATYYCQQYSNLPYTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 545 - protein, 5 aa, Artificial Sequence
  Description of Artificial Sequence: Synthetic peptide
EYTIH

SEQ ID NO: 546 - protein, 17 aa, Artificial Sequence
  Description of Artificial Sequence: Synthetic peptide
WFYPGTGSIKYNEKFKD

SEQ ID NO: 547 - protein, 15 aa, Artificial Sequence
  Description of Artificial Sequence: Synthetic peptide
HEDNHYYDGNSWFAY

SEQ ID NO: 548 - protein, 11 aa, Artificial Sequence
  Description of Artificial Sequence: Synthetic peptide
RASGNIHNYLA

SEQ ID NO: 549 - protein, 7 aa, Artificial Sequence
  Description of Artificial Sequence: Synthetic peptide
NAKTLAD

SEQ ID NO: 550 - protein, 9 aa, Artificial Sequence
  Description of Artificial Sequence: Synthetic peptide
QHFWSTPYT

SEQ ID NO: 551 - protein, 7 aa, Artificial Sequence
  Description of Artificial Sequence: Synthetic peptide
GYTFTEY

SEQ ID NO: 552 - protein, 6 aa, Artificial Sequence
  Description of Artificial Sequence: Synthetic peptide
YPGTGS

SEQ ID NO: 553 - protein, 14 aa, Artificial Sequence
  Description of Artificial Sequence: Synthetic peptide
HEDNHYYDGNSWFA

SEQ ID NO: 554 - protein, 7 aa, Artificial Sequence
  Description of Artificial Sequence: Synthetic peptide
SGNIHNY

SEQ ID NO: 555 - protein, 3 aa, Artificial Sequence
  Description of Artificial Sequence: Synthetic peptide
NAK

SEQ ID NO: 556 - protein, 6 aa, Artificial Sequence
  Description of Artificial Sequence: Synthetic peptide
FWSTPY

SEQ ID NO: 557 - protein, 10 aa, Artificial Sequence
  Description of Artificial Sequence: Synthetic peptide
GYTFTEYTIH

SEQ ID NO: 558 - protein, 10 aa, Artificial Sequence
  Description of Artificial Sequence: Synthetic peptide
WFYPGTGSIK

SEQ ID NO: 559 - protein, 15 aa, Artificial Sequence
  Description of Artificial Sequence: Synthetic peptide
HEDNHYYDGNSWFAY

SEQ ID NO: 560 - protein, 11 aa, Artificial Sequence
  Description of Artificial Sequence: Synthetic peptide
RASGNIHNYLA

SEQ ID NO: 561 - protein, 7 aa, Artificial Sequence
  Description of Artificial Sequence: Synthetic peptide
NAKTLAD

SEQ ID NO: 562 - protein, 9 aa, Artificial Sequence
  Description of Artificial Sequence: Synthetic peptide
QHFWSTPYT

SEQ ID NO: 563 - protein, 6 aa, Artificial Sequence
  Description of Artificial Sequence: Synthetic peptide
TEYTIH

SEQ ID NO: 564 - protein, 13 aa, Artificial Sequence
  Description of Artificial Sequence: Synthetic peptide
WIGWFYPGTGSIK

SEQ ID NO: 565 - protein, 16 aa, Artificial Sequence
  Description of Artificial Sequence: Synthetic peptide
ARHEDNHYYDGNSWFA

SEQ ID NO: 566 - protein, 7 aa, Artificial Sequence
  Description of Artificial Sequence: Synthetic peptide
HNYLAWF

SEQ ID NO: 567 - protein, 10 aa, Artificial Sequence
  Description of Artificial Sequence: Synthetic peptide
LLVYNAKTLA

SEQ ID NO: 568 - protein, 8 aa, Artificial Sequence
  Description of Artificial Sequence: Synthetic peptide
QHFWSTPY

SEQ ID NO: 569 - protein, 8 aa, Artificial Sequence
  Description of Artificial Sequence: Synthetic peptide
GYTFTEYT

SEQ ID NO: 570 - protein, 8 aa, Artificial Sequence
  Description of Artificial Sequence: Synthetic peptide
FYPGTGSI

SEQ ID NO: 571 - protein, 17 aa, Artificial Sequence
  Description of Artificial Sequence: Synthetic peptide
ARHEDNHYYDGNSWFAY

SEQ ID NO: 572 - protein, 6 aa, Artificial Sequence
  Description of Artificial Sequence: Synthetic peptide
GNIHNY

SEQ ID NO: 573 - protein, 3 aa, Artificial Sequence
  Description of Artificial Sequence: Synthetic peptide
NAK

SEQ ID NO: 574 - protein, 9 aa, Artificial Sequence
  Description of Artificial Sequence: Synthetic peptide
QHFWSTPYT

SEQ ID NO: 575 - protein, 124 aa, Artificial Sequence
  Description of Artificial Sequence: Synthetic polypeptide
QVQLQQSGAELVKPGASVKLSCKASGYTFTEYTIHWVKQRSGQGLEWIGWFYPGTGSIKYNEKFKDKATLTADKSSHTVYMELSKLTSEDSAVYFCARHEDNHYYDGNSWFAYWGQGTLVTVSA

SEQ ID NO: 576 - protein, 107 aa, Artificial Sequence
  Description of Artificial Sequence: Synthetic polypeptide
DIQMTQSPASLSASVGETVTITCRASGNIHNYLAWFQQKQGKSPQLLVYNAKTLADGVPSRFSGSGSGTQYSLKINSLQAEDFGSYYCQHFWSTPYTFGSGTKLEIK

SEQ ID NO: 577 - protein, 454 aa, Artificial Sequence
  Description of Artificial Sequence: Synthetic polypeptide
QVQLQQSGAELVKPGASVKLSCKASGYTFTEYTIHWVKQRSGQGLEWIGWFYPGTGSIKYNEKFKDKATLTADKSSHTVYMELSKLTSEDSAVYFCARHEDNHYYDGNSWFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 578 - protein, 214 aa, Artificial Sequence
  Description of Artificial Sequence: Synthetic polypeptide
DIQMTQSPASLSASVGETVTITCRASGNIHNYLAWFQQKQGKSPQLLVYNAKTLADGVPSRFSGSGSGTQYSLKINSLQAEDFGSYYCQHFWSTPYTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 579 - protein, 5 aa, Artificial Sequence
  Description of Artificial Sequence: Synthetic peptide
EYTIH

SEQ ID NO: 580 - protein, 17 aa, Artificial Sequence
  Description of Artificial Sequence: Synthetic peptide
WFYPGNGNMRYNEKFKD

SEQ ID NO: 581 - protein, 15 aa, Artificial Sequence
  Description of Artificial Sequence: Synthetic peptide
YEDNHYYDGASWFAY

SEQ ID NO: 582 - protein, 11 aa, Artificial Sequence
  Description of Artificial Sequence: Synthetic peptide
RASGNIHNYLA

SEQ ID NO: 583 - protein, 7 aa, Artificial Sequence
  Description of Artificial Sequence: Synthetic peptide
NAKTLAD

SEQ ID NO: 584 - protein, 9 aa, Artificial Sequence
  Description of Artificial Sequence: Synthetic peptide
QHFWSTPFT

SEQ ID NO: 585 - protein, 7 aa, Artificial Sequence
  Description of Artificial Sequence: Synthetic peptide
GYTFTEY

SEQ ID NO: 586 - protein, 6 aa, Artificial Sequence
  Description of Artificial Sequence: Synthetic peptide
YPGNGN

SEQ ID NO: 587 - protein, 14 aa, Artificial Sequence
  Description of Artificial Sequence: Synthetic peptide
YEDNHYYDGASWFA

SEQ ID NO: 588 - protein, 7 aa, Artificial Sequence
  Description of Artificial Sequence: Synthetic peptide
SGNIHNY

SEQ ID NO: 589 - protein, 3 aa, Artificial Sequence
  Description of Artificial Sequence: Synthetic peptide
NAK

SEQ ID NO: 590 - protein, 6 aa, Artificial Sequence
  Description of Artificial Sequence: Synthetic peptide
FWSTPF

SEQ ID NO: 591 - protein, 10 aa, Artificial Sequence
  Description of Artificial Sequence: Synthetic peptide
GYTFTEYTIH

SEQ ID NO: 592 - protein, 10 aa, Artificial Sequence
  Description of Artificial Sequence: Synthetic peptide
WFYPGNGNMR

SEQ ID NO: 593 - protein, 15 aa, Artificial Sequence
  Description of Artificial Sequence: Synthetic peptide
YEDNHYYDGASWFAY

SEQ ID NO: 594 - protein, 11 aa, Artificial Sequence
  Description of Artificial Sequence: Synthetic peptide
RASGNIHNYLA

SEQ ID NO: 595 - protein, 7 aa, Artificial Sequence
  Description of Artificial Sequence: Synthetic peptide
NAKTLAD

SEQ ID NO: 596 - protein, 9 aa, Artificial Sequence
  Description of Artificial Sequence: Synthetic peptide
QHFWSTPFT

SEQ ID NO: 597 - protein, 6 aa, Artificial Sequence
  Description of Artificial Sequence: Synthetic peptide
TEYTIH

SEQ ID NO: 598 - protein, 13 aa, Artificial Sequence
  Description of Artificial Sequence: Synthetic peptide
WIGWFYPGNGNMR

SEQ ID NO: 599 - protein, 16 aa, Artificial Sequence
  Description of Artificial Sequence: Synthetic peptide
ARYEDNHYYDGASWFA

SEQ ID NO: 600 - protein, 7 aa, Artificial Sequence
  Description of Artificial Sequence: Synthetic peptide
HNYLAWF

SEQ ID NO: 601 - protein, 10 aa, Artificial Sequence
  Description of Artificial Sequence: Synthetic peptide
LLVYNAKTLA

SEQ ID NO: 602 - protein, 8 aa, Artificial Sequence
  Description of Artificial Sequence: Synthetic peptide
QHFWSTPF

SEQ ID NO: 603 - protein, 8 aa, Artificial Sequence
  Description of Artificial Sequence: Synthetic peptide
GYTFTEYT

SEQ ID NO: 604 - protein, 8 aa, Artificial Sequence
  Description of Artificial Sequence: Synthetic peptide
FYPGNGNM

SEQ ID NO: 605 - protein, 17 aa, Artificial Sequence
  Description of Artificial Sequence: Synthetic peptide
ARYEDNHYYDGASWFAY

SEQ ID NO: 606 - protein, 6 aa, Artificial Sequence
  Description of Artificial Sequence: Synthetic peptide
GNIHNY

SEQ ID NO: 607 - protein, 3 aa, Artificial Sequence
  Description of Artificial Sequence: Synthetic peptide
NAK

SEQ ID NO: 608 - protein, 9 aa, Artificial Sequence
  Description of Artificial Sequence: Synthetic peptide
QHFWSTPFT

SEQ ID NO: 609 - protein, 124 aa, Artificial Sequence
  Description of Artificial Sequence: Synthetic polypeptide
QVQLQQSGAELVKPGASVKLSCKASGYTFTEYTIHWVKQKSGQGLEWIGWFYPGNGNMRYNEKFKDKATLTADRSSHTVYMELSRLTSEDSAVYFCARYEDNHYYDGASWFAYWGQGTSVTVSS

SEQ ID NO: 610 - protein, 107 aa, Artificial Sequence
  Description of Artificial Sequence: Synthetic polypeptide
DIQMTQSPASLSASVGDTVTITCRASGNIHNYLAWFQQKQGKSPQLLVYNAKTLADGVPSRFSGSGSGTQFSLKINSLQPEDFGTYYCQHFWSTPFTFGSGTKLEMK

SEQ ID NO: 611 - protein, 454 aa, Artificial Sequence
  Description of Artificial Sequence: Synthetic polypeptide
QVQLQQSGAELVKPGASVKLSCKASGYTFTEYTIHWVKQKSGQGLEWIGWFYPGNGNMRYNEKFKDKATLTADRSSHTVYMELSRLTSEDSAVYFCARYEDNHYYDGASWFAYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 612 - protein, 214 aa, Artificial Sequence
  Description of Artificial Sequence: Synthetic polypeptide
DIQMTQSPASLSASVGDTVTITCRASGNIHNYLAWFQQKQGKSPQLLVYNAKTLADGVPSRFSGSGSGTQFSLKINSLQPEDFGTYYCQHFWSTPFTFGSGTKLEMKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 613 - protein, 5 aa, Artificial Sequence
  Description of Artificial Sequence: Synthetic peptide
DDYIY

SEQ ID NO: 614 - protein, 17 aa, Artificial Sequence
  Description of Artificial Sequence: Synthetic peptide
WIDPENGATEYASKFQG

SEQ ID NO: 615 - protein, 9 aa, Artificial Sequence
  Description of Artificial Sequence: Synthetic peptide
HDYGYAMDY

SEQ ID NO: 616 - protein, 12 aa, Artificial Sequence
  Description of Artificial Sequence: Synthetic peptide
TASSSVSSSYLH

SEQ ID NO: 617 - protein, 7 aa, Artificial Sequence
  Description of Artificial Sequence: Synthetic peptide
STSNLAS

SEQ ID NO: 618 - protein, 9 aa, Artificial Sequence
  Description of Artificial Sequence: Synthetic peptide
HQYHRSPLT

SEQ ID NO: 619 - protein, 7 aa, Artificial Sequence
  Description of Artificial Sequence: Synthetic peptide
GFNFKDD

SEQ ID NO: 620 - protein, 6 aa, Artificial Sequence
  Description of Artificial Sequence: Synthetic peptide
DPENGA

SEQ ID NO: 621 - protein, 8 aa, Artificial Sequence
  Description of Artificial Sequence: Synthetic peptide
HDYGYAMD

SEQ ID NO: 622 - protein, 8 aa, Artificial Sequence
  Description of Artificial Sequence: Synthetic peptide
SSSVSSSY

SEQ ID NO: 623 - protein, 3 aa, Artificial Sequence
  Description of Artificial Sequence: Synthetic peptide
STS

SEQ ID NO: 624 - protein, 6 aa, Artificial Sequence
  Description of Artificial Sequence: Synthetic peptide
YHRSPL

SEQ ID NO: 625 - protein, 10 aa, Artificial Sequence
  Description of Artificial Sequence: Synthetic peptide
GFNFKDDYIY

SEQ ID NO: 626 - protein, 10 aa, Artificial Sequence
  Description of Artificial Sequence: Synthetic peptide
WIDPENGATE

SEQ ID NO: 627 - protein, 9 aa, Artificial Sequence
  Description of Artificial Sequence: Synthetic peptide
HDYGYAMDY

SEQ ID NO: 628 - protein, 12 aa, Artificial Sequence
  Description of Artificial Sequence: Synthetic peptide
TASSSVSSSYLH

SEQ ID NO: 629 - protein, 7 aa, Artificial Sequence
  Description of Artificial Sequence: Synthetic peptide
STSNLAS

SEQ ID NO: 630 - protein, 9 aa, Artificial Sequence
  Description of Artificial Sequence: Synthetic peptide
HQYHRSPLT

SEQ ID NO: 631 - protein, 6 aa, Artificial Sequence
  Description of Artificial Sequence: Synthetic peptide
KDDYIY

SEQ ID NO: 632 - protein, 13 aa, Artificial Sequence
  Description of Artificial Sequence: Synthetic peptide
WIGWIDPENGATE

SEQ ID NO: 633 - protein, 10 aa, Artificial Sequence
  Description of Artificial Sequence: Synthetic peptide
SLHDYGYAMD

SEQ ID NO: 634 - protein, 8 aa, Artificial Sequence
  Description of Artificial Sequence: Synthetic peptide
SSSYLHWY

SEQ ID NO: 635 - protein, 10 aa, Artificial Sequence
  Description of Artificial Sequence: Synthetic peptide
LWIYSTSNLA

SEQ ID NO: 636 - protein, 8 aa, Artificial Sequence
  Description of Artificial Sequence: Synthetic peptide
HQYHRSPL

SEQ ID NO: 637 - protein, 8 aa, Artificial Sequence
  Description of Artificial Sequence: Synthetic peptide
GFNFKDDY

SEQ ID NO: 638 - protein, 8 aa, Artificial Sequence
  Description of Artificial Sequence: Synthetic peptide
IDPENGAT

SEQ ID NO: 639 - protein, 11 aa, Artificial Sequence
  Description of Artificial Sequence: Synthetic peptide
SLHDYGYAMDY

SEQ ID NO: 640 - protein, 7 aa, Artificial Sequence
  Description of Artificial Sequence: Synthetic peptide
SSVSSSY

SEQ ID NO: 641 - protein, 3 aa, Artificial Sequence
  Description of Artificial Sequence: Synthetic peptide
STS

SEQ ID NO: 642 - protein, 9 aa, Artificial Sequence
  Description of Artificial Sequence: Synthetic peptide
HQYHRSPLT

SEQ ID NO: 643 - protein, 118 aa, Artificial Sequence
  Description of Artificial Sequence: Synthetic polypeptide
QVQLQQPGAELVKPGASVKLSCTGSGFNFKDDYIYWVKQRPEQGLEWIGWIDPENGATEYASKFQGKATITADTSSNIAYLQLSSLTSEDTAVYYCSLHDYGYAMDYWGQGTSVTVSS

SEQ ID NO: 644 - protein, 108 aa, Artificial Sequence
  Description of Artificial Sequence: Synthetic polypeptide
QIVLTQSPAIMSASLGERVTLTCTASSSVSSSYLHWYQQKPGSSPKLWIYSTSNLASGVPARFSGSGSGTSYSLTISNMEAEDAATYYCHQYHRSPLTFGGGTKLEIK

SEQ ID NO: 645 - protein, 448 aa, Artificial Sequence
  Description of Artificial Sequence: Synthetic polypeptide
QVQLQQPGAELVKPGASVKLSCTGSGFNFKDDYIYWVKQRPEQGLEWIGWIDPENGATEYASKFQGKATITADTSSNIAYLQLSSLTSEDTAVYYCSLHDYGYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 646 - protein, 215 aa, Artificial Sequence
  Description of Artificial Sequence: Synthetic polypeptide
QIVLTQSPAIMSASLGERVTLTCTASSSVSSSYLHWYQQKPGSSPKLWIYSTSNLASGVPARFSGSGSGTSYSLTISNMEAEDAATYYCHQYHRSPLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 647 - protein, 5 aa, Artificial Sequence
  Description of Artificial Sequence: Synthetic peptide
IYSIH

SEQ ID NO: 648 - protein, 16 aa, Artificial Sequence
  Description of Artificial Sequence: Synthetic peptide
MIWGGGSTDYNSTLNS

SEQ ID NO: 649 - protein, 14 aa, Artificial Sequence
  Description of Artificial Sequence: Synthetic peptide
NPHHYGGSTGAMDY

SEQ ID NO: 650 - protein, 11 aa, Artificial Sequence
  Description of Artificial Sequence: Synthetic peptide
KASQDIKKYMA

SEQ ID NO: 651 - protein, 7 aa, Artificial Sequence
  Description of Artificial Sequence: Synthetic peptide
YTSSLQP

SEQ ID NO: 652 - protein, 8 aa, Artificial Sequence
  Description of Artificial Sequence: Synthetic peptide
LQYDNLFT

SEQ ID NO: 653 - protein, 7 aa, Artificial Sequence
  Description of Artificial Sequence: Synthetic peptide
GFSLSIY

SEQ ID NO: 654 - protein, 5 aa, Artificial Sequence
  Description of Artificial Sequence: Synthetic peptide
WGGGS

SEQ ID NO: 655 - protein, 13 aa, Artificial Sequence
  Description of Artificial Sequence: Synthetic peptide
NPHHYGGSTGAMD

SEQ ID NO: 656 - protein, 7 aa, Artificial Sequence
  Description of Artificial Sequence: Synthetic peptide
SQDIKKY

SEQ ID NO: 657 - protein, 3 aa, Artificial Sequence
  Description of Artificial Sequence: Synthetic peptide
YTS

SEQ ID NO: 658 - protein, 5 aa, Artificial Sequence
  Description of Artificial Sequence: Synthetic peptide
YDNLF

SEQ ID NO: 659 - protein, 10 aa, Artificial Sequence
  Description of Artificial Sequence: Synthetic peptide
GFSLSIYSIH

SEQ ID NO: 660 - protein, 9 aa, Artificial Sequence
  Description of Artificial Sequence: Synthetic peptide
MIWGGGSTD

SEQ ID NO: 661 - protein, 14 aa, Artificial Sequence
  Description of Artificial Sequence: Synthetic peptide
NPHHYGGSTGAMDY

SEQ ID NO: 662 - protein, 11 aa, Artificial Sequence
  Description of Artificial Sequence: Synthetic peptide
KASQDIKKYMA

SEQ ID NO: 663 - protein, 7 aa, Artificial Sequence
  Description of Artificial Sequence: Synthetic peptide
YTSSLQP

SEQ ID NO: 664 - protein, 8 aa, Artificial Sequence
  Description of Artificial Sequence: Synthetic peptide
LQYDNLFT

SEQ ID NO: 665 - protein, 6 aa, Artificial Sequence
  Description of Artificial Sequence: Synthetic peptide
SIYSIH

SEQ ID NO: 666 - protein, 12 aa, Artificial Sequence
  Description of Artificial Sequence: Synthetic peptide
WLGMIWGGGSTD

SEQ ID NO: 667 - protein, 15 aa, Artificial Sequence
  Description of Artificial Sequence: Synthetic peptide
ARNPHHYGGSTGAMD

SEQ ID NO: 668 - protein, 7 aa, Artificial Sequence
  Description of Artificial Sequence: Synthetic peptide
KKYMAWY

SEQ ID NO: 669 - protein, 10 aa, Artificial Sequence
  Description of Artificial Sequence: Synthetic peptide
LLIHYTSSLQ

SEQ ID NO: 670 - protein, 7 aa, Artificial Sequence
  Description of Artificial Sequence: Synthetic peptide
LQYDNLF

SEQ ID NO: 671 - protein, 8 aa, Artificial Sequence
  Description of Artificial Sequence: Synthetic peptide
GFSLSIYS

SEQ ID NO: 672 - protein, 7 aa, Artificial Sequence
  Description of Artificial Sequence: Synthetic peptide
IWGGGST

SEQ ID NO: 673 - protein, 16 aa, Artificial Sequence
  Description of Artificial Sequence: Synthetic peptide
ARNPHHYGGSTGAMDY

SEQ ID NO: 674 - protein, 6 aa, Artificial Sequence
  Description of Artificial Sequence: Synthetic peptide
QDIKKY

SEQ ID NO: 675 - protein, 3 aa, Artificial Sequence
  Description of Artificial Sequence: Synthetic peptide
YTS

SEQ ID NO: 676 - protein, 8 aa, Artificial Sequence
  Description of Artificial Sequence: Synthetic peptide
LQYDNLFT

SEQ ID NO: 677 - protein, 122 aa, Artificial Sequence
  Description of Artificial Sequence: Synthetic polypeptide
QVQLKESGPGLVAPSQSLSITCTVSGFSLSIYSIHWVRQPPGKGLEWLGMIWGGGSTDYNSTLNSRLSIIKDNSKSQVFLKMNSLQTDDTAMYYCARNPHHYGGSTGAMDYWGQGTTVTVSS

SEQ ID NO: 678 - protein, 106 aa, Artificial Sequence
  Description of Artificial Sequence: Synthetic polypeptide
DVQMIQSPSSLSASLGGTVTITCKASQDIKKYMAWYQHKPGKGPRLLIHYTSSLQPGIPSRFSGSGSGRDYYFSISNLEPEDIATYFCLQYDNLFTFGSGTKLELK

SEQ ID NO: 679 - protein, 452 aa, Artificial Sequence
  Description of Artificial Sequence: Synthetic polypeptide
QVQLKESGPGLVAPSQSLSITCTVSGFSLSIYSIHWVRQPPGKGLEWLGMIWGGGSTDYNSTLNSRLSIIKDNSKSQVFLKMNSLQTDDTAMYYCARNPHHYGGSTGAMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 680 - protein, 213 aa, Artificial Sequence
  Description of Artificial Sequence: Synthetic polypeptide
DVQMIQSPSSLSASLGGTVTITCKASQDIKKYMAWYQHKPGKGPRLLIHYTSSLQPGIPSRFSGSGSGRDYYFSISNLEPEDIATYFCLQYDNLFTFGSGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 681 - protein, 7 aa, Artificial Sequence
  Description of Artificial Sequence: Synthetic peptide
TSGMNVG

SEQ ID NO: 682 - protein, 16 aa, Artificial Sequence
  Description of Artificial Sequence: Synthetic peptide
HIWWDDDKYYNPSLKS

SEQ ID NO: 683 - protein, 11 aa, Artificial Sequence
  Description of Artificial Sequence: Synthetic peptide
RGNYGNYEFAY

SEQ ID NO: 684 - protein, 11 aa, Artificial Sequence
  Description of Artificial Sequence: Synthetic peptide
RASQDIRNYLN

SEQ ID NO: 685 - protein, 7 aa, Artificial Sequence
  Description of Artificial Sequence: Synthetic peptide
HTSRLHS

SEQ ID NO: 686 - protein, 9 aa, Artificial Sequence
  Description of Artificial Sequence: Synthetic peptide
QQGNTLPWT

SEQ ID NO: 687 - protein, 9 aa, Artificial Sequence
  Description of Artificial Sequence: Synthetic peptide
GFSLSTSGM

SEQ ID NO: 688 - protein, 5 aa, Artificial Sequence
  Description of Artificial Sequence: Synthetic peptide
WWDDD

SEQ ID NO: 689 - protein, 10 aa, Artificial Sequence
  Description of Artificial Sequence: Synthetic peptide
RGNYGNYEFA

SEQ ID NO: 690 - protein, 7 aa, Artificial Sequence
  Description of Artificial Sequence: Synthetic peptide
SQDIRNY

SEQ ID NO: 691 - protein, 3 aa, Artificial Sequence
  Description of Artificial Sequence: Synthetic peptide
HTS

SEQ ID NO: 692 - protein, 6 aa, Artificial Sequence
  Description of Artificial Sequence: Synthetic peptide
GNTLPW

SEQ ID NO: 693 - protein, 12 aa, Artificial Sequence
  Description of Artificial Sequence: Synthetic peptide
GFSLSTSGMNVG

SEQ ID NO: 694 - protein, 9 aa, Artificial Sequence
  Description of Artificial Sequence: Synthetic peptide
HIWWDDDKY

SEQ ID NO: 695 - protein, 11 aa, Artificial Sequence
  Description of Artificial Sequence: Synthetic peptide
RGNYGNYEFAY

SEQ ID NO: 696 - protein, 11 aa, Artificial Sequence
  Description of Artificial Sequence: Synthetic peptide
RASQDIRNYLN

SEQ ID NO: 697 - protein, 7 aa, Artificial Sequence
  Description of Artificial Sequence: Synthetic peptide
HTSRLHS

SEQ ID NO: 698 - protein, 9 aa, Artificial Sequence
  Description of Artificial Sequence: Synthetic peptide
QQGNTLPWT

SEQ ID NO: 699 - protein, 8 aa, Artificial Sequence
  Description of Artificial Sequence: Synthetic peptide
STSGMNVG

SEQ ID NO: 700 - protein, 12 aa, Artificial Sequence
  Description of Artificial Sequence: Synthetic peptide
WLAHIWWDDDKY

SEQ ID NO: 701 - protein, 12 aa, Artificial Sequence
  Description of Artificial Sequence: Synthetic peptide
ARRGNYGNYEFA

SEQ ID NO: 702 - protein, 7 aa, Artificial Sequence
  Description of Artificial Sequence: Synthetic peptide
RNYLNWY

SEQ ID NO: 703 - protein, 10 aa, Artificial Sequence
  Description of Artificial Sequence: Synthetic peptide
LLIYHTSRLH

SEQ ID NO: 704 - protein, 8 aa, Artificial Sequence
  Description of Artificial Sequence: Synthetic peptide
QQGNTLPW

SEQ ID NO: 705 - protein, 10 aa, Artificial Sequence
  Description of Artificial Sequence: Synthetic peptide
GFSLSTSGMN

SEQ ID NO: 706 - protein, 7 aa, Artificial Sequence
  Description of Artificial Sequence: Synthetic peptide
IWWDDDK

SEQ ID NO: 707 - protein, 13 aa, Artificial Sequence
  Description of Artificial Sequence: Synthetic peptide
ARRGNYGNYEFAY

SEQ ID NO: 708 - protein, 6 aa, Artificial Sequence
  Description of Artificial Sequence: Synthetic peptide
QDIRNY

SEQ ID NO: 709 - protein, 3 aa, Artificial Sequence
  Description of Artificial Sequence: Synthetic peptide
HTS

SEQ ID NO: 710 - protein, 9 aa, Artificial Sequence
  Description of Artificial Sequence: Synthetic peptide
QQGNTLPWT

SEQ ID NO: 711 - protein, 121 aa, Artificial Sequence
  Description of Artificial Sequence: Synthetic polypeptide
QVTLKESGPGILKPSQTLSLTCSFSGFSLSTSGMNVGWIRQPSGKGLEWLAHIWWDDDKYYNPSLKSQLTISKDTSRNQVFLKITSVDTADTATYYCARRGNYGNYEFAYWGQGTTVTVSS

SEQ ID NO: 712 - protein, 107 aa, Artificial Sequence
  Description of Artificial Sequence: Synthetic polypeptide
DIQMTQTTSSLSASLGDRVTISCRASQDIRNYLNWYQQKPDGTVKLLIYHTSRLHSGVPSRFSGSGSGTDYSLTISNLDQEDIATYFCQQGNTLPWTFGAGTKLELK

SEQ ID NO: 713 - protein, 451 aa, Artificial Sequence
  Description of Artificial Sequence: Synthetic polypeptide
QVTLKESGPGILKPSQTLSLTCSFSGFSLSTSGMNVGWIRQPSGKGLEWLAHIWWDDDKYYNPSLKSQLTISKDTSRNQVFLKITSVDTADTATYYCARRGNYGNYEFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 714 - protein, 214 aa, Artificial Sequence
  Description of Artificial Sequence: Synthetic polypeptide
DIQMTQTTSSLSASLGDRVTISCRASQDIRNYLNWYQQKPDGTVKLLIYHTSRLHSGVPSRFSGSGSGTDYSLTISNLDQEDIATYFCQQGNTLPWTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 715 - protein, 5 aa, Artificial Sequence
  Description of Artificial Sequence: Synthetic peptide
SFWMH

SEQ ID NO: 716 - protein, 17 aa, Artificial Sequence
  Description of Artificial Sequence: Synthetic peptide
NVDPSDSQTHYNQKFKD

SEQ ID NO: 717 - protein, 12 aa, Artificial Sequence
  Description of Artificial Sequence: Synthetic peptide
STYYRYDGPFTY

SEQ ID NO: 718 - protein, 11 aa, Artificial Sequence
  Description of Artificial Sequence: Synthetic peptide
RASQSINNNLH

SEQ ID NO: 719 - protein, 7 aa, Artificial Sequence
  Description of Artificial Sequence: Synthetic peptide
YTSQSIS

SEQ ID NO: 720 - protein, 9 aa, Artificial Sequence
  Description of Artificial Sequence: Synthetic peptide
QQSNSWPLT

SEQ ID NO: 721 - protein, 7 aa, Artificial Sequence
  Description of Artificial Sequence: Synthetic peptide
GYTFTSF

SEQ ID NO: 722 - protein, 6 aa, Artificial Sequence
  Description of Artificial Sequence: Synthetic peptide
DPSDSQ

SEQ ID NO: 723 - protein, 11 aa, Artificial Sequence
  Description of Artificial Sequence: Synthetic peptide
STYYRYDGPFT

SEQ ID NO: 724 - protein, 7 aa, Artificial Sequence
  Description of Artificial Sequence: Synthetic peptide
SQSINNN

SEQ ID NO: 725 - protein, 3 aa, Artificial Sequence
  Description of Artificial Sequence: Synthetic peptide
YTS

SEQ ID NO: 726 - protein, 6 aa, Artificial Sequence
  Description of Artificial Sequence: Synthetic peptide
SNSWPL

SEQ ID NO: 727 - protein, 10 aa, Artificial Sequence
  Description of Artificial Sequence: Synthetic peptide
GYTFTSFWMH

SEQ ID NO: 728 - protein, 10 aa, Artificial Sequence
  Description of Artificial Sequence: Synthetic peptide
NVDPSDSQTH

SEQ ID NO: 729 - protein, 12 aa, Artificial Sequence
  Description of Artificial Sequence: Synthetic peptide
STYYRYDGPFTY

SEQ ID NO: 730 - protein, 11 aa, Artificial Sequence
  Description of Artificial Sequence: Synthetic peptide
RASQSINNNLH

SEQ ID NO: 731 - protein, 7 aa, Artificial Sequence
  Description of Artificial Sequence: Synthetic peptide
YTSQSIS

SEQ ID NO: 732 - protein, 9 aa, Artificial Sequence
  Description of Artificial Sequence: Synthetic peptide
QQSNSWPLT

SEQ ID NO: 733 - protein, 6 aa, Artificial Sequence
  Description of Artificial Sequence: Synthetic peptide
TSFWMH

SEQ ID NO: 734 - protein, 13 aa, Artificial Sequence
  Description of Artificial Sequence: Synthetic peptide
WIGNVDPSDSQTH

SEQ ID NO: 735 - protein, 13 aa, Artificial Sequence
  Description of Artificial Sequence: Synthetic peptide
ARSTYYRYDGPFT

SEQ ID NO: 736 - protein, 7 aa, Artificial Sequence
  Description of Artificial Sequence: Synthetic peptide
NNNLHWY

SEQ ID NO: 737 - protein, 10 aa, Artificial Sequence
  Description of Artificial Sequence: Synthetic peptide
LLIKYTSQSI

SEQ ID NO: 738 - protein, 8 aa, Artificial Sequence
  Description of Artificial Sequence: Synthetic peptide
QQSNSWPL

SEQ ID NO: 739 - protein, 8 aa, Artificial Sequence
  Description of Artificial Sequence: Synthetic peptide
GYTFTSFW

SEQ ID NO: 740 - protein, 8 aa, Artificial Sequence
  Description of Artificial Sequence: Synthetic peptide
VDPSDSQT

SEQ ID NO: 741 - protein, 14 aa, Artificial Sequence
  Description of Artificial Sequence: Synthetic peptide
ARSTYYRYDGPFTY

SEQ ID NO: 742 - protein, 6 aa, Artificial Sequence
  Description of Artificial Sequence: Synthetic peptide
QSINNN

SEQ ID NO: 743 - protein, 3 aa, Artificial Sequence
  Description of Artificial Sequence: Synthetic peptide
YTS

SEQ ID NO: 744 - protein, 9 aa, Artificial Sequence
  Description of Artificial Sequence: Synthetic peptide
QQSNSWPLT

SEQ ID NO: 745 - protein, 121 aa, Artificial Sequence
  Description of Artificial Sequence: Synthetic polypeptide
QVQLQQPGADLVKPGASVKLSCKASGYTFTSFWMHWVKQRPGQGLEWIGNVDPSDSQTHYNQKFKDKATLTVDKSSNTAYMQLSSLTSEDSAVYYCARSTYYRYDGPFTYWGQGTTVTVSS

SEQ ID NO: 746 - protein, 107 aa, Artificial Sequence
  Description of Artificial Sequence: Synthetic polypeptide
DIVLTQSPATLSVTPGDSVSLSCRASQSINNNLHWYQQKSHESPRLLIKYTSQSISGIPSRFSGSGSGPDFTLSINSVETEDFGMYFCQQSNSWPLTFGGGTKLEIK

SEQ ID NO: 747 - protein, 451 aa, Artificial Sequence
  Description of Artificial Sequence: Synthetic polypeptide
QVQLQQPGADLVKPGASVKLSCKASGYTFTSFWMHWVKQRPGQGLEWIGNVDPSDSQTHYNQKFKDKATLTVDKSSNTAYMQLSSLTSEDSAVYYCARSTYYRYDGPFTYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 748 - protein, 214 aa, Artificial Sequence
  Description of Artificial Sequence: Synthetic polypeptide
DIVLTQSPATLSVTPGDSVSLSCRASQSINNNLHWYQQKSHESPRLLIKYTSQSISGIPSRFSGSGSGPDFTLSINSVETEDFGMYFCQQSNSWPLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 749 - protein, 5 aa, Artificial Sequence
  Description of Artificial Sequence: Synthetic peptide
SYWMN

SEQ ID NO: 750 - protein, 17 aa, Artificial Sequence
  Description of Artificial Sequence: Synthetic peptide
AVNPSNSYTEYAQKFKD

SEQ ID NO: 751 - protein, 14 aa, Artificial Sequence
  Description of Artificial Sequence: Synthetic peptide
SGLYNTNHLAWFAY

SEQ ID NO: 752 - protein, 11 aa, Artificial Sequence
  Description of Artificial Sequence: Synthetic peptide
RASGNIHNYLA

SEQ ID NO: 753 - protein, 7 aa, Artificial Sequence
  Description of Artificial Sequence: Synthetic peptide
NAETLAD

SEQ ID NO: 754 - protein, 9 aa, Artificial Sequence
  Description of Artificial Sequence: Synthetic peptide
QHFWNNPLT

SEQ ID NO: 755 - protein, 7 aa, Artificial Sequence
  Description of Artificial Sequence: Synthetic peptide
GYTFTSY

SEQ ID NO: 756 - protein, 6 aa, Artificial Sequence
  Description of Artificial Sequence: Synthetic peptide
NPSNSY

SEQ ID NO: 757 - protein, 13 aa, Artificial Sequence
  Description of Artificial Sequence: Synthetic peptide
SGLYNTNHLAWFA

SEQ ID NO: 758 - protein, 7 aa, Artificial Sequence
  Description of Artificial Sequence: Synthetic peptide
SGNIHNY

SEQ ID NO: 759 - protein, 3 aa, Artificial Sequence
  Description of Artificial Sequence: Synthetic peptide
NAE

SEQ ID NO: 760 - protein, 6 aa, Artificial Sequence
  Description of Artificial Sequence: Synthetic peptide
FWNNPL

SEQ ID NO: 761 - protein, 10 aa, Artificial Sequence
  Description of Artificial Sequence: Synthetic peptide
GYTFTSYWMN

SEQ ID NO: 762 - protein, 10 aa, Artificial Sequence
  Description of Artificial Sequence: Synthetic peptide
AVNPSNSYTE

SEQ ID NO: 763 - protein, 14 aa, Artificial Sequence
  Description of Artificial Sequence: Synthetic peptide
SGLYNTNHLAWFAY

SEQ ID NO: 764 - protein, 11 aa, Artificial Sequence
  Description of Artificial Sequence: Synthetic peptide
RASGNIHNYLA

SEQ ID NO: 765 - protein, 7 aa, Artificial Sequence
  Description of Artificial Sequence: Synthetic peptide
NAETLAD

SEQ ID NO: 766 - protein, 9 aa, Artificial Sequence
  Description of Artificial Sequence: Synthetic peptide
QHFWNNPLT

SEQ ID NO: 767 - protein, 6 aa, Artificial Sequence
  Description of Artificial Sequence: Synthetic peptide
TSYWMN

SEQ ID NO: 768 - protein, 13 aa, Artificial Sequence
  Description of Artificial Sequence: Synthetic peptide
WIGAVNPSNSYTE

SEQ ID NO: 769 - protein, 15 aa, Artificial Sequence
  Description of Artificial Sequence: Synthetic peptide
ARSGLYNTNHLAWFA

SEQ ID NO: 770 - protein, 7 aa, Artificial Sequence
  Description of Artificial Sequence: Synthetic peptide
HNYLAWY

SEQ ID NO: 771 - protein, 10 aa, Artificial Sequence
  Description of Artificial Sequence: Synthetic peptide
LLVFNAETLA

SEQ ID NO: 772 - protein, 8 aa, Artificial Sequence
  Description of Artificial Sequence: Synthetic peptide
QHFWNNPL

SEQ ID NO: 773 - protein, 8 aa, Artificial Sequence
  Description of Artificial Sequence: Synthetic peptide
GYTFTSYW

SEQ ID NO: 774 - protein, 8 aa, Artificial Sequence
  Description of Artificial Sequence: Synthetic peptide
VNPSNSYT

SEQ ID NO: 775 - protein, 16 aa, Artificial Sequence
  Description of Artificial Sequence: Synthetic peptide
ARSGLYNTNHLAWFAY

SEQ ID NO: 776 - protein, 6 aa, Artificial Sequence
  Description of Artificial Sequence: Synthetic peptide
GNIHNY

SEQ ID NO: 777 - protein, 3 aa, Artificial Sequence
  Description of Artificial Sequence: Synthetic peptide
NAE

SEQ ID NO: 778 - protein, 9 aa, Artificial Sequence
  Description of Artificial Sequence: Synthetic peptide
QHFWNNPLT

SEQ ID NO: 779 - protein, 123 aa, Artificial Sequence
  Description of Artificial Sequence: Synthetic polypeptide
QVQLQQPGAELAKPGTSVKMSCKASGYTFTSYWMNWIKQRPGQGLEWIGAVNPSNSYTEYAQKFKDKAILTADKSSSTAYMSLSGLTSEASAVYYCARSGLYNTNHLAWFAYWGQGTLVTVSA

SEQ ID NO: 780 - protein, 107 aa, Artificial Sequence
  Description of Artificial Sequence: Synthetic polypeptide
DIQMTQSPASLSASVGETVTITCRASGNIHNYLAWYQQKQGKSPQLLVFNAETLADGVPSRFSGSGSGTQFSLKINSLQPEDFGTYYCQHFWNNPLTLGAGTKLELK

SEQ ID NO: 781 - protein, 453 aa, Artificial Sequence
  Description of Artificial Sequence: Synthetic polypeptide
QVQLQQPGAELAKPGTSVKMSCKASGYTFTSYWMNWIKQRPGQGLEWIGAVNPSNSYTEYAQKFKDKAILTADKSSSTAYMSLSGLTSEASAVYYCARSGLYNTNHLAWFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 782 - protein, 214 aa, Artificial Sequence
  Description of Artificial Sequence: Synthetic polypeptide
DIQMTQSPASLSASVGETVTITCRASGNIHNYLAWYQQKQGKSPQLLVFNAETLADGVPSRFSGSGSGTQFSLKINSLQPEDFGTYYCQHFWNNPLTLGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 783 - protein, 5 aa, Artificial Sequence
  Description of Artificial Sequence: Synthetic peptide
AYWIN

SEQ ID NO: 784 - protein, 17 aa, Artificial Sequence
  Description of Artificial Sequence: Synthetic peptide
SINPSNGYTEYSQKFKD

SEQ ID NO: 785 - protein, 14 aa, Artificial Sequence
  Description of Artificial Sequence: Synthetic peptide
SGLYYTNHLAWCPY

SEQ ID NO: 786 - protein, 11 aa, Artificial Sequence
  Description of Artificial Sequence: Synthetic peptide
RASGNIHNYLA

SEQ ID NO: 787 - protein, 7 aa, Artificial Sequence
  Description of Artificial Sequence: Synthetic peptide
NAETLAD

SEQ ID NO: 788 - protein, 9 aa, Artificial Sequence
  Description of Artificial Sequence: Synthetic peptide
QHFWNSPLT

SEQ ID NO: 789 - protein, 7 aa, Artificial Sequence
  Description of Artificial Sequence: Synthetic peptide
GYTFAAY

SEQ ID NO: 790 - protein, 6 aa, Artificial Sequence
  Description of Artificial Sequence: Synthetic peptide
NPSNGY

SEQ ID NO: 791 - protein, 13 aa, Artificial Sequence
  Description of Artificial Sequence: Synthetic peptide
SGLYYTNHLAWCP

SEQ ID NO: 792 - protein, 7 aa, Artificial Sequence
  Description of Artificial Sequence: Synthetic peptide
SGNIHNY

SEQ ID NO: 793 - protein, 3 aa, Artificial Sequence
  Description of Artificial Sequence: Synthetic peptide
NAE

SEQ ID NO: 794 - protein, 6 aa, Artificial Sequence
  Description of Artificial Sequence: Synthetic peptide
FWNSPL

SEQ ID NO: 795 - protein, 10 aa, Artificial Sequence
  Description of Artificial Sequence: Synthetic peptide
GYTFAAYWIN

SEQ ID NO: 796 - protein, 10 aa, Artificial Sequence
  Description of Artificial Sequence: Synthetic peptide
SINPSNGYTE

SEQ ID NO: 797 - protein, 14 aa, Artificial Sequence
  Description of Artificial Sequence: Synthetic peptide
SGLYYTNHLAWCPY

SEQ ID NO: 798 - protein, 11 aa, Artificial Sequence
  Description of Artificial Sequence: Synthetic peptide
RASGNIHNYLA

SEQ ID NO: 799 - protein, 7 aa, Artificial Sequence
  Description of Artificial Sequence: Synthetic peptide
NAETLAD

SEQ ID NO: 800 - protein, 9 aa, Artificial Sequence
  Description of Artificial Sequence: Synthetic peptide
QHFWNSPLT

SEQ ID NO: 801 - protein, 6 aa, Artificial Sequence
  Description of Artificial Sequence: Synthetic peptide
AAYWIN

SEQ ID NO: 802 - protein, 13 aa, Artificial Sequence
  Description of Artificial Sequence: Synthetic peptide
WIGSINPSNGYTE

SEQ ID NO: 803 - protein, 15 aa, Artificial Sequence
  Description of Artificial Sequence: Synthetic peptide
SRSGLYYTNHLAWCP

SEQ ID NO: 804 - protein, 7 aa, Artificial Sequence
  Description of Artificial Sequence: Synthetic peptide
HNYLAWY

SEQ ID NO: 805 - protein, 10 aa, Artificial Sequence
  Description of Artificial Sequence: Synthetic peptide
VLVYNAETLA

SEQ ID NO: 806 - protein, 8 aa, Artificial Sequence
  Description of Artificial Sequence: Synthetic peptide
QHFWNSPL

SEQ ID NO: 807 - protein, 8 aa, Artificial Sequence
  Description of Artificial Sequence: Synthetic peptide
GYTFAAYW

SEQ ID NO: 808 - protein, 8 aa, Artificial Sequence
  Description of Artificial Sequence: Synthetic peptide
INPSNGYT

SEQ ID NO: 809 - protein, 16 aa, Artificial Sequence
  Description of Artificial Sequence: Synthetic peptide
SRSGLYYTNHLAWCPY

SEQ ID NO: 810 - protein, 6 aa, Artificial Sequence
  Description of Artificial Sequence: Synthetic peptide
GNIHNY

SEQ ID NO: 811 - protein, 3 aa, Artificial Sequence
  Description of Artificial Sequence: Synthetic peptide
NAE

SEQ ID NO: 812 - protein, 9 aa, Artificial Sequence
  Description of Artificial Sequence: Synthetic peptide
QHFWNSPLT

SEQ ID NO: 813 - protein, 123 aa, Artificial Sequence
  Description of Artificial Sequence: Synthetic polypeptide
EVQLQQSGAELAKPGTSVKMSCKASGYTFAAYWINWLKQRPGQGLEWIGSINPSNGYTEYSQKFKDKAILTADKSSSTAYMQLSSLTSEDSAVYYCSRSGLYYTNHLAWCPYWGQGTTVTVSS

SEQ ID NO: 814 - protein, 107 aa, Artificial Sequence
  Description of Artificial Sequence: Synthetic polypeptide
DIVMTQSPASLSASVGETVTITCRASGNIHNYLAWYQQKQGKSPQVLVYNAETLADSVPSRFSGSGSGTQFSLKINSLQPEDFGNYYCQHFWNSPLTFGGGTKLEIK

SEQ ID NO: 815 - protein, 453 aa, Artificial Sequence
  Description of Artificial Sequence: Synthetic polypeptide
EVQLQQSGAELAKPGTSVKMSCKASGYTFAAYWINWLKQRPGQGLEWIGSINPSNGYTEYSQKFKDKAILTADKSSSTAYMQLSSLTSEDSAVYYCSRSGLYYTNHLAWCPYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 816 - protein, 214 aa, Artificial Sequence
  Description of Artificial Sequence: Synthetic polypeptide
DIVMTQSPASLSASVGETVTITCRASGNIHNYLAWYQQKQGKSPQVLVYNAETLADSVPSRFSGSGSGTQFSLKINSLQPEDFGNYYCQHFWNSPLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 817 - protein, 6 aa, Artificial Sequence
  Description of Artificial Sequence: Synthetic peptide
SGYYWN

SEQ ID NO: 818 - protein, 16 aa, Artificial Sequence
  Description of Artificial Sequence: Synthetic peptide
YISYDGSNNYNPSLKN

SEQ ID NO: 819 - protein, 8 aa, Artificial Sequence
  Description of Artificial Sequence: Synthetic peptide
NHGDAMDY

SEQ ID NO: 820 - protein, 11 aa, Artificial Sequence
  Description of Artificial Sequence: Synthetic peptide
KASQNVGTAVA

SEQ ID NO: 821 - protein, 7 aa, Artificial Sequence
  Description of Artificial Sequence: Synthetic peptide
SASYRYT

SEQ ID NO: 822 - protein, 8 aa, Artificial Sequence
  Description of Artificial Sequence: Synthetic peptide
QQYSSYLT

SEQ ID NO: 823 - protein, 8 aa, Artificial Sequence
  Description of Artificial Sequence: Synthetic peptide
GYSITSGY

SEQ ID NO: 824 - protein, 5 aa, Artificial Sequence
  Description of Artificial Sequence: Synthetic peptide
SYDGS

SEQ ID NO: 825 - protein, 7 aa, Artificial Sequence
  Description of Artificial Sequence: Synthetic peptide
NHGDAMD

SEQ ID NO: 826 - protein, 7 aa, Artificial Sequence
  Description of Artificial Sequence: Synthetic peptide
SQNVGTA

SEQ ID NO: 827 - protein, 3 aa, Artificial Sequence
  Description of Artificial Sequence: Synthetic peptide
SAS

SEQ ID NO: 828 - protein, 5 aa, Artificial Sequence
  Description of Artificial Sequence: Synthetic peptide
YSSYL

SEQ ID NO: 829 - protein, 11 aa, Artificial Sequence
  Description of Artificial Sequence: Synthetic peptide
GYSITSGYYWN

SEQ ID NO: 830 - protein, 9 aa, Artificial Sequence
  Description of Artificial Sequence: Synthetic peptide
YISYDGSNN

SEQ ID NO: 831 - protein, 8 aa, Artificial Sequence
  Description of Artificial Sequence: Synthetic peptide
NHGDAMDY

SEQ ID NO: 832 - protein, 11 aa, Artificial Sequence
  Description of Artificial Sequence: Synthetic peptide
KASQNVGTAVA

SEQ ID NO: 833 - protein, 7 aa, Artificial Sequence
  Description of Artificial Sequence: Synthetic peptide
SASYRYT

SEQ ID NO: 834 - protein, 8 aa, Artificial Sequence
  Description of Artificial Sequence: Synthetic peptide
QQYSSYLT

SEQ ID NO: 835 - protein, 7 aa, Artificial Sequence
  Description of Artificial Sequence: Synthetic peptide
TSGYYWN

SEQ ID NO: 836 - protein, 12 aa, Artificial Sequence
  Description of Artificial Sequence: Synthetic peptide
WMGYISYDGSNN

SEQ ID NO: 837 - protein, 9 aa, Artificial Sequence
  Description of Artificial Sequence: Synthetic peptide
VRNHGDAMD

SEQ ID NO: 838 - protein, 7 aa, Artificial Sequence
  Description of Artificial Sequence: Synthetic peptide
GTAVAWY

SEQ ID NO: 839 - protein, 10 aa, Artificial Sequence
  Description of Artificial Sequence: Synthetic peptide
LLIYSASYRY

SEQ ID NO: 840 - protein, 7 aa, Artificial Sequence
  Description of Artificial Sequence: Synthetic peptide
QQYSSYL

SEQ ID NO: 841 - protein, 9 aa, Artificial Sequence
  Description of Artificial Sequence: Synthetic peptide
GYSITSGYY

SEQ ID NO: 842 - protein, 7 aa, Artificial Sequence
  Description of Artificial Sequence: Synthetic peptide
ISYDGSN

SEQ ID NO: 843 - protein, 10 aa, Artificial Sequence
  Description of Artificial Sequence: Synthetic peptide
VRNHGDAMDY

SEQ ID NO: 844 - protein, 6 aa, Artificial Sequence
  Description of Artificial Sequence: Synthetic peptide
QNVGTA

SEQ ID NO: 845 - protein, 3 aa, Artificial Sequence
  Description of Artificial Sequence: Synthetic peptide
SAS

SEQ ID NO: 846 - protein, 8 aa, Artificial Sequence
  Description of Artificial Sequence: Synthetic peptide
QQYSSYLT

SEQ ID NO: 847 - protein, 117 aa, Artificial Sequence
  Description of Artificial Sequence: Synthetic polypeptide
DVQLQESGPGLVKPSQSLSLTCSVTGYSITSGYYWNWIRQFPGNKLEWMGYISYDGSNNYNPSLKNRISITRDTSKNQFFLKLNSVTTEDTATYYCVRNHGDAMDYWGQGTSVTVSS

SEQ ID NO: 848 - protein, 106 aa, Artificial Sequence
  Description of Artificial Sequence: Synthetic polypeptide
DIVLTQSQKFMSTTVGDRVSITCKASQNVGTAVAWYQQKPGQSPKLLIYSASYRYTGVPDRFTGSGSGTHFTLTISNMQSEDLADYFCQQYSSYLTFGSGTKLEIK

SEQ ID NO: 849 - protein, 447 aa, Artificial Sequence
  Description of Artificial Sequence: Synthetic polypeptide
DVQLQESGPGLVKPSQSLSLTCSVTGYSITSGYYWNWIRQFPGNKLEWMGYISYDGSNNYNPSLKNRISITRDTSKNQFFLKLNSVTTEDTATYYCVRNHGDAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 850 - protein, 213 aa, Artificial Sequence
  Description of Artificial Sequence: Synthetic polypeptide
DIVLTQSQKFMSTTVGDRVSITCKASQNVGTAVAWYQQKPGQSPKLLIYSASYRYTGVPDRFTGSGSGTHFTLTISNMQSEDLADYFCQQYSSYLTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 851 - protein, 5 aa, Artificial Sequence
  Description of Artificial Sequence: Synthetic peptide
NTYIS

SEQ ID NO: 852 - protein, 17 aa, Artificial Sequence
  Description of Artificial Sequence: Synthetic peptide
WIYTGTGGTWYNQKFTD

SEQ ID NO: 853 - protein, 9 aa, Artificial Sequence
  Description of Artificial Sequence: Synthetic peptide
TNWDWYFDV

SEQ ID NO: 854 - protein, 11 aa, Artificial Sequence
  Description of Artificial Sequence: Synthetic peptide
RASENIYSYLA

SEQ ID NO: 855 - protein, 7 aa, Artificial Sequence
  Description of Artificial Sequence: Synthetic peptide
YAKTLTD

SEQ ID NO: 856 - protein, 9 aa, Artificial Sequence
  Description of Artificial Sequence: Synthetic peptide
QHHYGRPYT

SEQ ID NO: 857 - protein, 7 aa, Artificial Sequence
  Description of Artificial Sequence: Synthetic peptide
GFTFTNT

SEQ ID NO: 858 - protein, 6 aa, Artificial Sequence
  Description of Artificial Sequence: Synthetic peptide
YTGTGG

SEQ ID NO: 859 - protein, 8 aa, Artificial Sequence
  Description of Artificial Sequence: Synthetic peptide
TNWDWYFD

SEQ ID NO: 860 - protein, 7 aa, Artificial Sequence
  Description of Artificial Sequence: Synthetic peptide
SENIYSY

SEQ ID NO: 861 - protein, 3 aa, Artificial Sequence
  Description of Artificial Sequence: Synthetic peptide
YAK

SEQ ID NO: 862 - protein, 6 aa, Artificial Sequence
  Description of Artificial Sequence: Synthetic peptide
HYGRPY

SEQ ID NO: 863 - protein, 10 aa, Artificial Sequence
  Description of Artificial Sequence: Synthetic peptide
GFTFTNTYIS

SEQ ID NO: 864 - protein, 10 aa, Artificial Sequence
  Description of Artificial Sequence: Synthetic peptide
WIYTGTGGTW

SEQ ID NO: 865 - protein, 9 aa, Artificial Sequence
  Description of Artificial Sequence: Synthetic peptide
TNWDWYFDV

SEQ ID NO: 866 - protein, 11 aa, Artificial Sequence
  Description of Artificial Sequence: Synthetic peptide
RASENIYSYLA

SEQ ID NO: 867 - protein, 7 aa, Artificial Sequence
  Description of Artificial Sequence: Synthetic peptide
YAKTLTD

SEQ ID NO: 868 - protein, 9 aa, Artificial Sequence
  Description of Artificial Sequence: Synthetic peptide
QHHYGRPYT

SEQ ID NO: 869 - protein, 6 aa, Artificial Sequence
  Description of Artificial Sequence: Synthetic peptide
TNTYIS

SEQ ID NO: 870 - protein, 13 aa, Artificial Sequence
  Description of Artificial Sequence: Synthetic peptide
WIAWIYTGTGGTW

SEQ ID NO: 871 - protein, 10 aa, Artificial Sequence
  Description of Artificial Sequence: Synthetic peptide
ARTNWDWYFD

SEQ ID NO: 872 - protein, 7 aa, Artificial Sequence
  Description of Artificial Sequence: Synthetic peptide
YSYLAWY

SEQ ID NO: 873 - protein, 10 aa, Artificial Sequence
  Description of Artificial Sequence: Synthetic peptide
LLVYYAKTLT

SEQ ID NO: 874 - protein, 8 aa, Artificial Sequence
  Description of Artificial Sequence: Synthetic peptide
QHHYGRPY

SEQ ID NO: 875 - protein, 8 aa, Artificial Sequence
  Description of Artificial Sequence: Synthetic peptide
GFTFTNTY

SEQ ID NO: 876 - protein, 8 aa, Artificial Sequence
  Description of Artificial Sequence: Synthetic peptide
IYTGTGGT

SEQ ID NO: 877 - protein, 11 aa, Artificial Sequence
  Description of Artificial Sequence: Synthetic peptide
ARTNWDWYFDV

SEQ ID NO: 878 - protein, 6 aa, Artificial Sequence
  Description of Artificial Sequence: Synthetic peptide
ENIYSY

SEQ ID NO: 879 - protein, 3 aa, Artificial Sequence
  Description of Artificial Sequence: Synthetic peptide
YAK

SEQ ID NO: 880 - protein, 9 aa, Artificial Sequence
  Description of Artificial Sequence: Synthetic peptide
QHHYGRPYT

SEQ ID NO: 881 - protein, 118 aa, Artificial Sequence
  Description of Artificial Sequence: Synthetic polypeptide
QVQLQQSGAELVKPGASVKLSCKTSGFTFTNTYISWLKQKPRQSLEWIAWIYTGTGGTWYNQKFTDKAQLTVDTSSSTAYMQVSSLTSEDSAIYYCARTNWDWYFDVWGAGTSVTVSS

SEQ ID NO: 882 - protein, 107 aa, Artificial Sequence
  Description of Artificial Sequence: Synthetic polypeptide
DIVMTQSPASLSASVGETVTITCRASENIYSYLAWYQQKQGKSPQLLVYYAKTLTDGVPSRFSGSGSGTQFSLKINSLQPEDFGSYYCQHHYGRPYTFGSGTKLEIK

SEQ ID NO: 883 - protein, 448 aa, Artificial Sequence
  Description of Artificial Sequence: Synthetic polypeptide
QVQLQQSGAELVKPGASVKLSCKTSGFTFTNTYISWLKQKPRQSLEWIAWIYTGTGGTWYNQKFTDKAQLTVDTSSSTAYMQVSSLTSEDSAIYYCARTNWDWYFDVWGAGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 884 - protein, 214 aa, Artificial Sequence
  Description of Artificial Sequence: Synthetic polypeptide
DIVMTQSPASLSASVGETVTITCRASENIYSYLAWYQQKQGKSPQLLVYYAKTLTDGVPSRFSGSGSGTQFSLKINSLQPEDFGSYYCQHHYGRPYTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 885 - protein, 5 aa, Artificial Sequence
  Description of Artificial Sequence: Synthetic peptide
DYYMA

SEQ ID NO: 886 - protein, 17 aa, Artificial Sequence
  Description of Artificial Sequence: Synthetic peptide
HINYDGSITYYLDSLKS

SEQ ID NO: 887 - protein, 10 aa, Artificial Sequence
  Description of Artificial Sequence: Synthetic peptide
EDYSNYGFAY

SEQ ID NO: 888 - protein, 11 aa, Artificial Sequence
  Description of Artificial Sequence: Synthetic peptide
HASQNINVWLS

SEQ ID NO: 889 - protein, 7 aa, Artificial Sequence
  Description of Artificial Sequence: Synthetic peptide
KASNLHT

SEQ ID NO: 890 - protein, 9 aa, Artificial Sequence
  Description of Artificial Sequence: Synthetic peptide
QQGQSYPLT

SEQ ID NO: 891 - protein, 7 aa, Artificial Sequence
  Description of Artificial Sequence: Synthetic peptide
GFTFSDY

SEQ ID NO: 892 - protein, 6 aa, Artificial Sequence
  Description of Artificial Sequence: Synthetic peptide
NYDGSI

SEQ ID NO: 893 - protein, 9 aa, Artificial Sequence
  Description of Artificial Sequence: Synthetic peptide
EDYSNYGFA

SEQ ID NO: 894 - protein, 7 aa, Artificial Sequence
  Description of Artificial Sequence: Synthetic peptide
SQNINVW

SEQ ID NO: 895 - protein, 3 aa, Artificial Sequence
  Description of Artificial Sequence: Synthetic peptide
KAS

SEQ ID NO: 896 - protein, 6 aa, Artificial Sequence
  Description of Artificial Sequence: Synthetic peptide
GQSYPL

SEQ ID NO: 897 - protein, 10 aa, Artificial Sequence
  Description of Artificial Sequence: Synthetic peptide
GFTFSDYYMA

SEQ ID NO: 898 - protein, 10 aa, Artificial Sequence
  Description of Artificial Sequence: Synthetic peptide
HINYDGSITY

SEQ ID NO: 899 - protein, 10 aa, Artificial Sequence
  Description of Artificial Sequence: Synthetic peptide
EDYSNYGFAY

SEQ ID NO: 900 - protein, 11 aa, Artificial Sequence
  Description of Artificial Sequence: Synthetic peptide
HASQNINVWLS

SEQ ID NO: 901 - protein, 7 aa, Artificial Sequence
  Description of Artificial Sequence: Synthetic peptide
KASNLHT

SEQ ID NO: 902 - protein, 9 aa, Artificial Sequence
  Description of Artificial Sequence: Synthetic peptide
QQGQSYPLT

SEQ ID NO: 903 - protein, 6 aa, Artificial Sequence
  Description of Artificial Sequence: Synthetic peptide
SDYYMA

SEQ ID NO: 904 - protein, 13 aa, Artificial Sequence
  Description of Artificial Sequence: Synthetic peptide
WVAHINYDGSITY

SEQ ID NO: 905 - protein, 11 aa, Artificial Sequence
  Description of Artificial Sequence: Synthetic peptide
AREDYSNYGFA

SEQ ID NO: 906 - protein, 7 aa, Artificial Sequence
  Description of Artificial Sequence: Synthetic peptide
NVWLSWY

SEQ ID NO: 907 - protein, 10 aa, Artificial Sequence
  Description of Artificial Sequence: Synthetic peptide
LLIYKASNLH

SEQ ID NO: 908 - protein, 8 aa, Artificial Sequence
  Description of Artificial Sequence: Synthetic peptide
QQGQSYPL

SEQ ID NO: 909 - protein, 8 aa, Artificial Sequence
  Description of Artificial Sequence: Synthetic peptide
GFTFSDYY

SEQ ID NO: 910 - protein, 8 aa, Artificial Sequence
  Description of Artificial Sequence: Synthetic peptide
INYDGSIT

SEQ ID NO: 911 - protein, 12 aa, Artificial Sequence
  Description of Artificial Sequence: Synthetic peptide
AREDYSNYGFAY

SEQ ID NO: 912 - protein, 6 aa, Artificial Sequence
  Description of Artificial Sequence: Synthetic peptide
QNINVW

SEQ ID NO: 913 - protein, 3 aa, Artificial Sequence
  Description of Artificial Sequence: Synthetic peptide
KAS

SEQ ID NO: 914 - protein, 9 aa, Artificial Sequence
  Description of Artificial Sequence: Synthetic peptide
QQGQSYPLT

SEQ ID NO: 915 - protein, 119 aa, Artificial Sequence
  Description of Artificial Sequence: Synthetic polypeptide
EVKLVESGGGLVQPGSSMKLSCTASGFTFSDYYMAWVRQVPEKGLEWVAHINYDGSITYYLDSLKSRFIISRDNAKNILYLQMSSLKSEDTATYYCAREDYSNYGFAYWGQGTLVTVSA

SEQ ID NO: 916 - protein, 107 aa, Artificial Sequence
  Description of Artificial Sequence: Synthetic polypeptide
NTQMNQTPSSLSASLGDTITITCHASQNINVWLSWYQQKPGNIPKLLIYKASNLHTGVPSRFSGSGSGTGFTLTISSLQPEDIATYYCQQGQSYPLTFGSGTKLEMK

SEQ ID NO: 917 - protein, 449 aa, Artificial Sequence
  Description of Artificial Sequence: Synthetic polypeptide
EVKLVESGGGLVQPGSSMKLSCTASGFTFSDYYMAWVRQVPEKGLEWVAHINYDGSITYYLDSLKSRFIISRDNAKNILYLQMSSLKSEDTATYYCAREDYSNYGFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 918 - protein, 214 aa, Artificial Sequence
  Description of Artificial Sequence: Synthetic polypeptide
NTQMNQTPSSLSASLGDTITITCHASQNINVWLSWYQQKPGNIPKLLIYKASNLHTGVPSRFSGSGSGTGFTLTISSLQPEDIATYYCQQGQSYPLTFGSGTKLEMKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 919 - protein, 5 aa, Artificial Sequence
  Description of Artificial Sequence: Synthetic peptide
SYWMN

SEQ ID NO: 920 - protein, 17 aa, Artificial Sequence
  Description of Artificial Sequence: Synthetic peptide
AVNPTNYYTEYIQKFKD

SEQ ID NO: 921 - protein, 14 aa, Artificial Sequence
  Description of Artificial Sequence: Synthetic peptide
SGLYNTNHLAWFAY

SEQ ID NO: 922 - protein, 11 aa, Artificial Sequence
  Description of Artificial Sequence: Synthetic peptide
RASENIHNYLA

SEQ ID NO: 923 - protein, 7 aa, Artificial Sequence
  Description of Artificial Sequence: Synthetic peptide
NAKTLAN

SEQ ID NO: 924 - protein, 9 aa, Artificial Sequence
  Description of Artificial Sequence: Synthetic peptide
QHFWTTPLT

SEQ ID NO: 925 - protein, 7 aa, Artificial Sequence
  Description of Artificial Sequence: Synthetic peptide
GYTFTSY

SEQ ID NO: 926 - protein, 6 aa, Artificial Sequence
  Description of Artificial Sequence: Synthetic peptide
NPTNYY

SEQ ID NO: 927 - protein, 13 aa, Artificial Sequence
  Description of Artificial Sequence: Synthetic peptide
SGLYNTNHLAWFA

SEQ ID NO: 928 - protein, 7 aa, Artificial Sequence
  Description of Artificial Sequence: Synthetic peptide
SENIHNY

SEQ ID NO: 929 - protein, 3 aa, Artificial Sequence
  Description of Artificial Sequence: Synthetic peptide
NAK

SEQ ID NO: 930 - protein, 6 aa, Artificial Sequence
  Description of Artificial Sequence: Synthetic peptide
FWTTPL

SEQ ID NO: 931 - protein, 10 aa, Artificial Sequence
  Description of Artificial Sequence: Synthetic peptide
GYTFTSYWMN

SEQ ID NO: 932 - protein, 10 aa, Artificial Sequence
  Description of Artificial Sequence: Synthetic peptide
AVNPTNYYTE

SEQ ID NO: 933 - protein, 14 aa, Artificial Sequence
  Description of Artificial Sequence: Synthetic peptide
SGLYNTNHLAWFAY

SEQ ID NO: 934 - protein, 11 aa, Artificial Sequence
  Description of Artificial Sequence: Synthetic peptide
RASENIHNYLA

SEQ ID NO: 935 - protein, 7 aa, Artificial Sequence
  Description of Artificial Sequence: Synthetic peptide
NAKTLAN

SEQ ID NO: 936 - protein, 9 aa, Artificial Sequence
  Description of Artificial Sequence: Synthetic peptide
QHFWTTPLT

SEQ ID NO: 937 - protein, 6 aa, Artificial Sequence
  Description of Artificial Sequence: Synthetic peptide
TSYWMN

SEQ ID NO: 938 - protein, 13 aa, Artificial Sequence
  Description of Artificial Sequence: Synthetic peptide
WIGAVNPTNYYTE

SEQ ID NO: 939 - protein, 15 aa, Artificial Sequence
  Description of Artificial Sequence: Synthetic peptide
ARSGLYNTNHLAWFA

SEQ ID NO: 940 - protein, 7 aa, Artificial Sequence
  Description of Artificial Sequence: Synthetic peptide
HNYLAWY

SEQ ID NO: 941 - protein, 10 aa, Artificial Sequence
  Description of Artificial Sequence: Synthetic peptide
LLVYNAKTLA

SEQ ID NO: 942 - protein, 8 aa, Artificial Sequence
  Description of Artificial Sequence: Synthetic peptide
QHFWTTPL

SEQ ID NO: 943 - protein, 8 aa, Artificial Sequence
  Description of Artificial Sequence: Synthetic peptide
GYTFTSYW

SEQ ID NO: 944 - protein, 8 aa, Artificial Sequence
  Description of Artificial Sequence: Synthetic peptide
VNPTNYYT

SEQ ID NO: 945 - protein, 16 aa, Artificial Sequence
  Description of Artificial Sequence: Synthetic peptide
ARSGLYNTNHLAWFAY

SEQ ID NO: 946 - protein, 6 aa, Artificial Sequence
  Description of Artificial Sequence: Synthetic peptide
ENIHNY

SEQ ID NO: 947 - protein, 3 aa, Artificial Sequence
  Description of Artificial Sequence: Synthetic peptide
NAK

SEQ ID NO: 948 - protein, 9 aa, Artificial Sequence
  Description of Artificial Sequence: Synthetic peptide
QHFWTTPLT

SEQ ID NO: 949 - protein, 123 aa, Artificial Sequence
  Description of Artificial Sequence: Synthetic polypeptide
EVQLQQSGAALAKPGTSVKMSCKASGYTFTSYWMNWVRQRPGQGLEWIGAVNPTNYYTEYIQKFKDKAILTADKSSSTAYMHLSGLTSEDSAVYYCARSGLYNTNHLAWFAYWGQGTTVTVSS

SEQ ID NO: 950 - protein, 107 aa, Artificial Sequence
  Description of Artificial Sequence: Synthetic polypeptide
DIKMTQSPASLSASVGETVTITCRASENIHNYLAWYQQIQGKSPQLLVYNAKTLANGVPSRFSGSASGTQFSLTINSLQPEDFGSYYCQHFWTTPLTFGAGTKLELK

SEQ ID NO: 951 - protein, 453 aa, Artificial Sequence
  Description of Artificial Sequence: Synthetic polypeptide
EVQLQQSGAALAKPGTSVKMSCKASGYTFTSYWMNWVRQRPGQGLEWIGAVNPTNYYTEYIQKFKDKAILTADKSSSTAYMHLSGLTSEDSAVYYCARSGLYNTNHLAWFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 952 - protein, 214 aa, Artificial Sequence
  Description of Artificial Sequence: Synthetic polypeptide
DIKMTQSPASLSASVGETVTITCRASENIHNYLAWYQQIQGKSPQLLVYNAKTLANGVPSRFSGSASGTQFSLTINSLQPEDFGSYYCQHFWTTPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 953 - protein, 5 aa, Artificial Sequence
  Description of Artificial Sequence: Synthetic peptide
SYWMH

SEQ ID NO: 954 - protein, 17 aa, Artificial Sequence
  Description of Artificial Sequence: Synthetic peptide
NIDPSDSETHYNQKFKD

SEQ ID NO: 955 - protein, 15 aa, Artificial Sequence
  Description of Artificial Sequence: Synthetic peptide
VYYSYYSYDATYFDY

SEQ ID NO: 956 - protein, 11 aa, Artificial Sequence
  Description of Artificial Sequence: Synthetic peptide
RASENIYSYLA

SEQ ID NO: 957 - protein, 7 aa, Artificial Sequence
  Description of Artificial Sequence: Synthetic peptide
NAKTLAE

SEQ ID NO: 958 - protein, 9 aa, Artificial Sequence
  Description of Artificial Sequence: Synthetic peptide
QHHYTTPLT

SEQ ID NO: 959 - protein, 7 aa, Artificial Sequence
  Description of Artificial Sequence: Synthetic peptide
GYSFNSY

SEQ ID NO: 960 - protein, 6 aa, Artificial Sequence
  Description of Artificial Sequence: Synthetic peptide
DPSDSE

SEQ ID NO: 961 - protein, 14 aa, Artificial Sequence
  Description of Artificial Sequence: Synthetic peptide
VYYSYYSYDATYFD

SEQ ID NO: 962 - protein, 7 aa, Artificial Sequence
  Description of Artificial Sequence: Synthetic peptide
SENIYSY

SEQ ID NO: 963 - protein, 3 aa, Artificial Sequence
  Description of Artificial Sequence: Synthetic peptide
NAK

SEQ ID NO: 964 - protein, 6 aa, Artificial Sequence
  Description of Artificial Sequence: Synthetic peptide
HYTTPL

SEQ ID NO: 965 - protein, 10 aa, Artificial Sequence
  Description of Artificial Sequence: Synthetic peptide
GYSFNSYWMH

SEQ ID NO: 966 - protein, 10 aa, Artificial Sequence
  Description of Artificial Sequence: Synthetic peptide
NIDPSDSETH

SEQ ID NO: 967 - protein, 15 aa, Artificial Sequence
  Description of Artificial Sequence: Synthetic peptide
VYYSYYSYDATYFDY

SEQ ID NO: 968 - protein, 11 aa, Artificial Sequence
  Description of Artificial Sequence: Synthetic peptide
RASENIYSYLA

SEQ ID NO: 969 - protein, 7 aa, Artificial Sequence
  Description of Artificial Sequence: Synthetic peptide
NAKTLAE

SEQ ID NO: 970 - protein, 9 aa, Artificial Sequence
  Description of Artificial Sequence: Synthetic peptide
QHHYTTPLT

SEQ ID NO: 971 - protein, 6 aa, Artificial Sequence
  Description of Artificial Sequence: Synthetic peptide
NSYWMH

SEQ ID NO: 972 - protein, 13 aa, Artificial Sequence
  Description of Artificial Sequence: Synthetic peptide
WIGNIDPSDSETH

SEQ ID NO: 973 - protein, 16 aa, Artificial Sequence
  Description of Artificial Sequence: Synthetic peptide
ARVYYSYYSYDATYFD

SEQ ID NO: 974 - protein, 7 aa, Artificial Sequence
  Description of Artificial Sequence: Synthetic peptide
YSYLAWY

SEQ ID NO: 975 - protein, 10 aa, Artificial Sequence
  Description of Artificial Sequence: Synthetic peptide
LLVYNAKTLA

SEQ ID NO: 976 - protein, 8 aa, Artificial Sequence
  Description of Artificial Sequence: Synthetic peptide
QHHYTTPL

SEQ ID NO: 977 - protein, 8 aa, Artificial Sequence
  Description of Artificial Sequence: Synthetic peptide
GYSFNSYW

SEQ ID NO: 978 - protein, 8 aa, Artificial Sequence
  Description of Artificial Sequence: Synthetic peptide
IDPSDSET

SEQ ID NO: 979 - protein, 17 aa, Artificial Sequence
  Description of Artificial Sequence: Synthetic peptide
ARVYYSYYSYDATYFDY

SEQ ID NO: 980 - protein, 6 aa, Artificial Sequence
  Description of Artificial Sequence: Synthetic peptide
ENIYSY

SEQ ID NO: 981 - protein, 3 aa, Artificial Sequence
  Description of Artificial Sequence: Synthetic peptide
NAK

SEQ ID NO: 982 - protein, 9 aa, Artificial Sequence
  Description of Artificial Sequence: Synthetic peptide
QHHYTTPLT

SEQ ID NO: 983 - protein, 124 aa, Artificial Sequence
  Description of Artificial Sequence: Synthetic polypeptide
QVQLQQPGAELVKPGASVKLSCKASGYSFNSYWMHWVKQRPGQGLEWIGNIDPSDSETHYNQKFKDKATLTVDKSSSTAYMQLSSLTSEDSAVYYCARVYYSYYSYDATYFDYWGQGTTLTVSS

SEQ ID NO: 984 - protein, 107 aa, Artificial Sequence
  Description of Artificial Sequence: Synthetic polypeptide
DIQMTQSPASLSASVGETVTITCRASENIYSYLAWYQQKQGKSPQLLVYNAKTLAEGVPSRFSGSGSGTQFSLKINSLQPEDFGSYYCQHHYTTPLTFGGGTKLEIK

SEQ ID NO: 985 - protein, 454 aa, Artificial Sequence
  Description of Artificial Sequence: Synthetic polypeptide
QVQLQQPGAELVKPGASVKLSCKASGYSFNSYWMHWVKQRPGQGLEWIGNIDPSDSETHYNQKFKDKATLTVDKSSSTAYMQLSSLTSEDSAVYYCARVYYSYYSYDATYFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 986 - protein, 214 aa, Artificial Sequence
  Description of Artificial Sequence: Synthetic polypeptide
DIQMTQSPASLSASVGETVTITCRASENIYSYLAWYQQKQGKSPQLLVYNAKTLAEGVPSRFSGSGSGTQFSLKINSLQPEDFGSYYCQHHYTTPLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 987 - protein, 5 aa, Artificial Sequence
  Description of Artificial Sequence: Synthetic peptide
SYSVH

SEQ ID NO: 988 - protein, 16 aa, Artificial Sequence
  Description of Artificial Sequence: Synthetic peptide
VIWAGGSTNYNSAFMS

SEQ ID NO: 989 - protein, 11 aa, Artificial Sequence
  Description of Artificial Sequence: Synthetic peptide
HSYYSFDAFDY

SEQ ID NO: 990 - protein, 11 aa, Artificial Sequence
  Description of Artificial Sequence: Synthetic peptide
KASQNVNTDVA

SEQ ID NO: 991 - protein, 7 aa, Artificial Sequence
  Description of Artificial Sequence: Synthetic peptide
SASYRYS

SEQ ID NO: 992 - protein, 9 aa, Artificial Sequence
  Description of Artificial Sequence: Synthetic peptide
QQCNSYPLT

SEQ ID NO: 993 - protein, 7 aa, Artificial Sequence
  Description of Artificial Sequence: Synthetic peptide
GFSLTSY

SEQ ID NO: 994 - protein, 5 aa, Artificial Sequence
  Description of Artificial Sequence: Synthetic peptide
WAGGS

SEQ ID NO: 995 - protein, 10 aa, Artificial Sequence
  Description of Artificial Sequence: Synthetic peptide
HSYYSFDAFD

SEQ ID NO: 996 - protein, 7 aa, Artificial Sequence
  Description of Artificial Sequence: Synthetic peptide
SQNVNTD

SEQ ID NO: 997 - protein, 3 aa, Artificial Sequence
  Description of Artificial Sequence: Synthetic peptide
SAS

SEQ ID NO: 998 - protein, 6 aa, Artificial Sequence
  Description of Artificial Sequence: Synthetic peptide
CNSYPL

SEQ ID NO: 999 - protein, 10 aa, Artificial Sequence
  Description of Artificial Sequence: Synthetic peptide
GFSLTSYSVH

SEQ ID NO: 1000 - protein, 9 aa, Artificial Sequence
  Description of Artificial Sequence: Synthetic peptide
VIWAGGSTN

SEQ ID NO: 1001 - protein, 11 aa, Artificial Sequence
  Description of Artificial Sequence: Synthetic peptide
HSYYSFDAFDY

SEQ ID NO: 1002 - protein, 11 aa, Artificial Sequence
  Description of Artificial Sequence: Synthetic peptide
KASQNVNTDVA

SEQ ID NO: 1003 - protein, 7 aa, Artificial Sequence
  Description of Artificial Sequence: Synthetic peptide
SASYRYS

SEQ ID NO: 1004 - protein, 9 aa, Artificial Sequence
  Description of Artificial Sequence: Synthetic peptide
QQCNSYPLT

SEQ ID NO: 1005 - protein, 6 aa, Artificial Sequence
  Description of Artificial Sequence: Synthetic peptide
TSYSVH

SEQ ID NO: 1006 - protein, 12 aa, Artificial Sequence
  Description of Artificial Sequence: Synthetic peptide
WLGVIWAGGSTN

SEQ ID NO: 1007 - protein, 12 aa, Artificial Sequence
  Description of Artificial Sequence: Synthetic peptide
AKHSYYSFDAFD

SEQ ID NO: 1008 - protein, 7 aa, Artificial Sequence
  Description of Artificial Sequence: Synthetic peptide
NTDVAWY

SEQ ID NO: 1009 - protein, 10 aa, Artificial Sequence
  Description of Artificial Sequence: Synthetic peptide
ALIYSASYRY

SEQ ID NO: 1010 - protein, 8 aa, Artificial Sequence
  Description of Artificial Sequence: Synthetic peptide
QQCNSYPL

SEQ ID NO: 1011 - protein, 8 aa, Artificial Sequence
  Description of Artificial Sequence: Synthetic peptide
GFSLTSYS

SEQ ID NO: 1012 - protein, 7 aa, Artificial Sequence
  Description of Artificial Sequence: Synthetic peptide
IWAGGST

SEQ ID NO: 1013 - protein, 13 aa, Artificial Sequence
  Description of Artificial Sequence: Synthetic peptide
AKHSYYSFDAFDY

SEQ ID NO: 1014 - protein, 6 aa, Artificial Sequence
  Description of Artificial Sequence: Synthetic peptide
QNVNTD

SEQ ID NO: 1015 - protein, 3 aa, Artificial Sequence
  Description of Artificial Sequence: Synthetic peptide
SAS

SEQ ID NO: 1016 - protein, 9 aa, Artificial Sequence
  Description of Artificial Sequence: Synthetic peptide
QQCNSYPLT

SEQ ID NO: 1017 - protein, 119 aa, Artificial Sequence
  Description of Artificial Sequence: Synthetic polypeptide
DVQLQESGPILVAPSQSLSITCTVSGFSLTSYSVHWVRQPPGKGLEWLGVIWAGGSTNYNSAFMSRLTISKDNSESQVFLKMISLQTDDTAMYYCAKHSYYSFDAFDYWGQGTTLTVSS

SEQ ID NO: 1018 - protein, 107 aa, Artificial Sequence
  Description of Artificial Sequence: Synthetic polypeptide
DIVMTQSQKFMSTSVGDRVRVTCKASQNVNTDVAWYQQKPGQSPKALIYSASYRYSGVPDRFTGSGSGTDFTLTISNVQSEDLAEYFCQQCNSYPLTFGAGTKLELK

SEQ ID NO: 1019 - protein, 449 aa, Artificial Sequence
  Description of Artificial Sequence: Synthetic polypeptide
DVQLQESGPILVAPSQSLSITCTVSGFSLTSYSVHWVRQPPGKGLEWLGVIWAGGSTNYNSAFMSRLTISKDNSESQVFLKMISLQTDDTAMYYCAKHSYYSFDAFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1020 - protein, 214 aa, Artificial Sequence
  Description of Artificial Sequence: Synthetic polypeptide
DIVMTQSQKFMSTSVGDRVRVTCKASQNVNTDVAWYQQKPGQSPKALIYSASYRYSGVPDRFTGSGSGTDFTLTISNVQSEDLAEYFCQQCNSYPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1021 - protein, 6 aa, Artificial Sequence
  Description of Artificial Sequence: Synthetic peptide
SGYYWN

SEQ ID NO: 1022 - protein, 16 aa, Artificial Sequence
  Description of Artificial Sequence: Synthetic peptide
YINYDGRNNYNPSLKN

SEQ ID NO: 1023 - protein, 11 aa, Artificial Sequence
  Description of Artificial Sequence: Synthetic peptide
DQGYSKFYFDY

SEQ ID NO: 1024 - protein, 11 aa, Artificial Sequence
  Description of Artificial Sequence: Synthetic peptide
KASEDIYNRLA

SEQ ID NO: 1025 - protein, 7 aa, Artificial Sequence
  Description of Artificial Sequence: Synthetic peptide
GATSLET

SEQ ID NO: 1026 - protein, 9 aa, Artificial Sequence
  Description of Artificial Sequence: Synthetic peptide
QQYWSFPRT

SEQ ID NO: 1027 - protein, 8 aa, Artificial Sequence
  Description of Artificial Sequence: Synthetic peptide
GYSITSGY

SEQ ID NO: 1028 - protein, 5 aa, Artificial Sequence
  Description of Artificial Sequence: Synthetic peptide
NYDGR

SEQ ID NO: 1029 - protein, 10 aa, Artificial Sequence
  Description of Artificial Sequence: Synthetic peptide
DQGYSKFYFD

SEQ ID NO: 1030 - protein, 7 aa, Artificial Sequence
  Description of Artificial Sequence: Synthetic peptide
SEDIYNR

SEQ ID NO: 1031 - protein, 3 aa, Artificial Sequence
  Description of Artificial Sequence: Synthetic peptide
GAT

SEQ ID NO: 1032 - protein, 6 aa, Artificial Sequence
  Description of Artificial Sequence: Synthetic peptide
YWSFPR

SEQ ID NO: 1033 - protein, 11 aa, Artificial Sequence
  Description of Artificial Sequence: Synthetic peptide
GYSITSGYYWN

SEQ ID NO: 1034 - protein, 9 aa, Artificial Sequence
  Description of Artificial Sequence: Synthetic peptide
YINYDGRNN

SEQ ID NO: 1035 - protein, 11 aa, Artificial Sequence
  Description of Artificial Sequence: Synthetic peptide
DQGYSKFYFDY

SEQ ID NO: 1036 - protein, 11 aa, Artificial Sequence
  Description of Artificial Sequence: Synthetic peptide
KASEDIYNRLA

SEQ ID NO: 1037 - protein, 7 aa, Artificial Sequence
  Description of Artificial Sequence: Synthetic peptide
GATSLET

SEQ ID NO: 1038 - protein, 9 aa, Artificial Sequence
  Description of Artificial Sequence: Synthetic peptide
QQYWSFPRT

SEQ ID NO: 1039 - protein, 7 aa, Artificial Sequence
  Description of Artificial Sequence: Synthetic peptide
TSGYYWN

SEQ ID NO: 1040 - protein, 12 aa, Artificial Sequence
  Description of Artificial Sequence: Synthetic peptide
WMGYINYDGRNN

SEQ ID NO: 1041 - protein, 12 aa, Artificial Sequence
  Description of Artificial Sequence: Synthetic peptide
SRDQGYSKFYFD

SEQ ID NO: 1042 - protein, 7 aa, Artificial Sequence
  Description of Artificial Sequence: Synthetic peptide
YNRLAWY

SEQ ID NO: 1043 - protein, 10 aa, Artificial Sequence
  Description of Artificial Sequence: Synthetic peptide
LLISGATSLE

SEQ ID NO: 1044 - protein, 8 aa, Artificial Sequence
  Description of Artificial Sequence: Synthetic peptide
QQYWSFPR

SEQ ID NO: 1045 - protein, 9 aa, Artificial Sequence
  Description of Artificial Sequence: Synthetic peptide
GYSITSGYY

SEQ ID NO: 1046 - protein, 7 aa, Artificial Sequence
  Description of Artificial Sequence: Synthetic peptide
INYDGRN

SEQ ID NO: 1047 - protein, 13 aa, Artificial Sequence
  Description of Artificial Sequence: Synthetic peptide
SRDQGYSKFYFDY

SEQ ID NO: 1048 - protein, 6 aa, Artificial Sequence
  Description of Artificial Sequence: Synthetic peptide
EDIYNR

SEQ ID NO: 1049 - protein, 3 aa, Artificial Sequence
  Description of Artificial Sequence: Synthetic peptide
GAT

SEQ ID NO: 1050 - protein, 9 aa, Artificial Sequence
  Description of Artificial Sequence: Synthetic peptide
QQYWSFPRT

SEQ ID NO: 1051 - protein, 120 aa, Artificial Sequence
  Description of Artificial Sequence: Synthetic polypeptide
QVQLKESGPGLVKPSQSLSLTCSVTGYSITSGYYWNWIRQFPGNKLEWMGYINYDGRNNYNPSLKNRISITRDTSKNHFFLKLNSVTTEDTATYYCSRDQGYSKFYFDYWGQGTTLTVSS

SEQ ID NO: 1052 - protein, 107 aa, Artificial Sequence
  Description of Artificial Sequence: Synthetic polypeptide
DIQMTQSSSSFSVSLGDRVTITCKASEDIYNRLAWYQQRPGNAPRLLISGATSLETGVPSRFSGGGSGKDYTLSITSLQTEDVANYYCQQYWSFPRTFGGGTKLEIK

SEQ ID NO: 1053 - protein, 450 aa, Artificial Sequence
  Description of Artificial Sequence: Synthetic polypeptide
QVQLKESGPGLVKPSQSLSLTCSVTGYSITSGYYWNWIRQFPGNKLEWMGYINYDGRNNYNPSLKNRISITRDTSKNHFFLKLNSVTTEDTATYYCSRDQGYSKFYFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1054 - protein, 214 aa, Artificial Sequence
  Description of Artificial Sequence: Synthetic polypeptide
DIQMTQSSSSFSVSLGDRVTITCKASEDIYNRLAWYQQRPGNAPRLLISGATSLETGVPSRFSGGGSGKDYTLSITSLQTEDVANYYCQQYWSFPRTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1055 - protein, 5 aa, Artificial Sequence
  Description of Artificial Sequence: Synthetic peptide
TYAVH

SEQ ID NO: 1056 - protein, 16 aa, Artificial Sequence
  Description of Artificial Sequence: Synthetic peptide
VIWSGGSTDYNAAFIS

SEQ ID NO: 1057 - protein, 11 aa, Artificial Sequence
  Description of Artificial Sequence: Synthetic peptide
HSYYHYNAMDN

SEQ ID NO: 1058 - protein, 11 aa, Artificial Sequence
  Description of Artificial Sequence: Synthetic peptide
KASQNVGTAVA

SEQ ID NO: 1059 - protein, 7 aa, Artificial Sequence
  Description of Artificial Sequence: Synthetic peptide
SASNRYT

SEQ ID NO: 1060 - protein, 9 aa, Artificial Sequence
  Description of Artificial Sequence: Synthetic peptide
QQYSSYPFT

SEQ ID NO: 1061 - protein, 7 aa, Artificial Sequence
  Description of Artificial Sequence: Synthetic peptide
GFSLTTY

SEQ ID NO: 1062 - protein, 5 aa, Artificial Sequence
  Description of Artificial Sequence: Synthetic peptide
WSGGS

SEQ ID NO: 1063 - protein, 10 aa, Artificial Sequence
  Description of Artificial Sequence: Synthetic peptide
HSYYHYNAMD

SEQ ID NO: 1064 - protein, 7 aa, Artificial Sequence
  Description of Artificial Sequence: Synthetic peptide
SQNVGTA

SEQ ID NO: 1065 - protein, 3 aa, Artificial Sequence
  Description of Artificial Sequence: Synthetic peptide
SAS

SEQ ID NO: 1066 - protein, 6 aa, Artificial Sequence
  Description of Artificial Sequence: Synthetic peptide
YSSYPF

SEQ ID NO: 1067 - protein, 10 aa, Artificial Sequence
  Description of Artificial Sequence: Synthetic peptide
GFSLTTYAVH

SEQ ID NO: 1068 - protein, 9 aa, Artificial Sequence
  Description of Artificial Sequence: Synthetic peptide
VIWSGGSTD

SEQ ID NO: 1069 - protein, 11 aa, Artificial Sequence
  Description of Artificial Sequence: Synthetic peptide
HSYYHYNAMDN

SEQ ID NO: 1070 - protein, 11 aa, Artificial Sequence
  Description of Artificial Sequence: Synthetic peptide
KASQNVGTAVA

SEQ ID NO: 1071 - protein, 7 aa, Artificial Sequence
  Description of Artificial Sequence: Synthetic peptide
SASNRYT

SEQ ID NO: 1072 - protein, 9 aa, Artificial Sequence
  Description of Artificial Sequence: Synthetic peptide
QQYSSYPFT

SEQ ID NO: 1073 - protein, 6 aa, Artificial Sequence
  Description of Artificial Sequence: Synthetic peptide
TTYAVH

SEQ ID NO: 1074 - protein, 12 aa, Artificial Sequence
  Description of Artificial Sequence: Synthetic peptide
WLGVIWSGGSTD

SEQ ID NO: 1075 - protein, 12 aa, Artificial Sequence
  Description of Artificial Sequence: Synthetic peptide
ARHSYYHYNAMD

SEQ ID NO: 1076 - protein, 7 aa, Artificial Sequence
  Description of Artificial Sequence: Synthetic peptide
GTAVAWY

SEQ ID NO: 1077 - protein, 10 aa, Artificial Sequence
  Description of Artificial Sequence: Synthetic peptide
LLIYSASNRY

SEQ ID NO: 1078 - protein, 8 aa, Artificial Sequence
  Description of Artificial Sequence: Synthetic peptide
QQYSSYPF

SEQ ID NO: 1079 - protein, 8 aa, Artificial Sequence
  Description of Artificial Sequence: Synthetic peptide
GFSLTTYA

SEQ ID NO: 1080 - protein, 7 aa, Artificial Sequence
  Description of Artificial Sequence: Synthetic peptide
IWSGGST

SEQ ID NO: 1081 - protein, 13 aa, Artificial Sequence
  Description of Artificial Sequence: Synthetic peptide
ARHSYYHYNAMDN

SEQ ID NO: 1082 - protein, 6 aa, Artificial Sequence
  Description of Artificial Sequence: Synthetic peptide
QNVGTA

SEQ ID NO: 1083 - protein, 3 aa, Artificial Sequence
  Description of Artificial Sequence: Synthetic peptide
SAS

SEQ ID NO: 1084 - protein, 9 aa, Artificial Sequence
  Description of Artificial Sequence: Synthetic peptide
QQYSSYPFT

SEQ ID NO: 1085 - protein, 119 aa, Artificial Sequence
  Description of Artificial Sequence: Synthetic polypeptide
QVQLKGSGPGLVQPSQSLSITCTVSGFSLTTYAVHWVRQSPGKGLEWLGVIWSGGSTDYNAAFISRLSISKDNSKSQVFFKMNSLQADDTAIYYCARHSYYHYNAMDNWGQGTSVTVSS

SEQ ID NO: 1086 - protein, 107 aa, Artificial Sequence
  Description of Artificial Sequence: Synthetic polypeptide
DIKMTQSQKFMSTTVGDRVSITCKASQNVGTAVAWYQQKPGQSPKLLIYSASNRYTGVPDRFTGSGSGTDFTLTISNMQSEDLADYFCQQYSSYPFTFGSGTKLEIK

SEQ ID NO: 1087 - protein, 449 aa, Artificial Sequence
  Description of Artificial Sequence: Synthetic polypeptide
QVQLKGSGPGLVQPSQSLSITCTVSGFSLTTYAVHWVRQSPGKGLEWLGVIWSGGSTDYNAAFISRLSISKDNSKSQVFFKMNSLQADDTAIYYCARHSYYHYNAMDNWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1088 - protein, 214 aa, Artificial Sequence
  Description of Artificial Sequence: Synthetic polypeptide
DIKMTQSQKFMSTTVGDRVSITCKASQNVGTAVAWYQQKPGQSPKLLIYSASNRYTGVPDRFTGSGSGTDFTLTISNMQSEDLADYFCQQYSSYPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1089 - protein, 6 aa, Artificial Sequence
  Description of Artificial Sequence: Synthetic peptide
SGYYWN

SEQ ID NO: 1090 - protein, 16 aa, Artificial Sequence
  Description of Artificial Sequence: Synthetic peptide
YISYDGSNNYNPSLKN

SEQ ID NO: 1091 - protein, 8 aa, Artificial Sequence
  Description of Artificial Sequence: Synthetic peptide
NHGDAMDH

SEQ ID NO: 1092 - protein, 11 aa, Artificial Sequence
  Description of Artificial Sequence: Synthetic peptide
KASQNVGTDVA

SEQ ID NO: 1093 - protein, 7 aa, Artificial Sequence
  Description of Artificial Sequence: Synthetic peptide
SASYRYS

SEQ ID NO: 1094 - protein, 9 aa, Artificial Sequence
  Description of Artificial Sequence: Synthetic peptide
QQYKSYPLT

SEQ ID NO: 1095 - protein, 8 aa, Artificial Sequence
  Description of Artificial Sequence: Synthetic peptide
GYSITSGY

SEQ ID NO: 1096 - protein, 5 aa, Artificial Sequence
  Description of Artificial Sequence: Synthetic peptide
SYDGS

SEQ ID NO: 1097 - protein, 7 aa, Artificial Sequence
  Description of Artificial Sequence: Synthetic peptide
NHGDAMD

SEQ ID NO: 1098 - protein, 7 aa, Artificial Sequence
  Description of Artificial Sequence: Synthetic peptide
SQNVGTD

SEQ ID NO: 1099 - protein, 3 aa, Artificial Sequence
  Description of Artificial Sequence: Synthetic peptide
SAS

SEQ ID NO: 1100 - protein, 6 aa, Artificial Sequence
  Description of Artificial Sequence: Synthetic peptide
YKSYPL

SEQ ID NO: 1101 - protein, 11 aa, Artificial Sequence
  Description of Artificial Sequence: Synthetic peptide
GYSITSGYYWN

SEQ ID NO: 1102 - protein, 9 aa, Artificial Sequence
  Description of Artificial Sequence: Synthetic peptide
YISYDGSNN

SEQ ID NO: 1103 - protein, 8 aa, Artificial Sequence
  Description of Artificial Sequence: Synthetic peptide
NHGDAMDH

SEQ ID NO: 1104 - protein, 11 aa, Artificial Sequence
  Description of Artificial Sequence: Synthetic peptide
KASQNVGTDVA

SEQ ID NO: 1105 - protein, 7 aa, Artificial Sequence
  Description of Artificial Sequence: Synthetic peptide
SASYRYS

SEQ ID NO: 1106 - protein, 9 aa, Artificial Sequence
  Description of Artificial Sequence: Synthetic peptide
QQYKSYPLT

SEQ ID NO: 1107 - protein, 7 aa, Artificial Sequence
  Description of Artificial Sequence: Synthetic peptide
TSGYYWN

SEQ ID NO: 1108 - protein, 12 aa, Artificial Sequence
  Description of Artificial Sequence: Synthetic peptide
WMGYISYDGSNN

SEQ ID NO: 1109 - protein, 9 aa, Artificial Sequence
  Description of Artificial Sequence: Synthetic peptide
VRNHGDAMD

SEQ ID NO: 1110 - protein, 7 aa, Artificial Sequence
  Description of Artificial Sequence: Synthetic peptide
GTDVAWY

SEQ ID NO: 1111 - protein, 10 aa, Artificial Sequence
  Description of Artificial Sequence: Synthetic peptide
ALIYSASYRY

SEQ ID NO: 1112 - protein, 8 aa, Artificial Sequence
  Description of Artificial Sequence: Synthetic peptide
QQYKSYPL

SEQ ID NO: 1113 - protein, 9 aa, Artificial Sequence
  Description of Artificial Sequence: Synthetic peptide
GYSITSGYY

SEQ ID NO: 1114 - protein, 7 aa, Artificial Sequence
  Description of Artificial Sequence: Synthetic peptide
ISYDGSN

SEQ ID NO: 1115 - protein, 10 aa, Artificial Sequence
  Description of Artificial Sequence: Synthetic peptide
VRNHGDAMDH

SEQ ID NO: 1116 - protein, 6 aa, Artificial Sequence
  Description of Artificial Sequence: Synthetic peptide
QNVGTD

SEQ ID NO: 1117 - protein, 3 aa, Artificial Sequence
  Description of Artificial Sequence: Synthetic peptide
SAS

SEQ ID NO: 1118 - protein, 9 aa, Artificial Sequence
  Description of Artificial Sequence: Synthetic peptide
QQYKSYPLT

SEQ ID NO: 1119 - protein, 117 aa, Artificial Sequence
  Description of Artificial Sequence: Synthetic polypeptide
DVQLQESGPGLVKPSQSLSLTCSVTGYSITSGYYWNWIRQFPGNKLEWMGYISYDGSNNYNPSLKNRISITRDTSKNQFFLKLNSVTTEDTATYYCVRNHGDAMDHWGQGTTLTVSS

SEQ ID NO: 1120 - protein, 107 aa, Artificial Sequence
  Description of Artificial Sequence: Synthetic polypeptide
DIVMTQSQKFMSTSVGDRVRVTCKASQNVGTDVAWYQQKPGQSPKALIYSASYRYSGVPDRFTGSGSGTDFTLTISDVQSEDLAEYFCQQYKSYPLTFGAGTKLELK

SEQ ID NO: 1121 - protein, 447 aa, Artificial Sequence
  Description of Artificial Sequence: Synthetic polypeptide
DVQLQESGPGLVKPSQSLSLTCSVTGYSITSGYYWNWIRQFPGNKLEWMGYISYDGSNNYNPSLKNRISITRDTSKNQFFLKLNSVTTEDTATYYCVRNHGDAMDHWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1122 - protein, 214 aa, Artificial Sequence
  Description of Artificial Sequence: Synthetic polypeptide
DIVMTQSQKFMSTSVGDRVRVTCKASQNVGTDVAWYQQKPGQSPKALIYSASYRYSGVPDRFTGSGSGTDFTLTISDVQSEDLAEYFCQQYKSYPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1123 - protein, 5 aa, Artificial Sequence
  Description of Artificial Sequence: Synthetic peptide
RYSVH

SEQ ID NO: 1124 - protein, 16 aa, Artificial Sequence
  Description of Artificial Sequence: Synthetic peptide
MIWGGGSTDYNSALKS

SEQ ID NO: 1125 - protein, 11 aa, Artificial Sequence
  Description of Artificial Sequence: Synthetic peptide
IYFDNYVGFAY

SEQ ID NO: 1126 - protein, 11 aa, Artificial Sequence
  Description of Artificial Sequence: Synthetic peptide
KASQDVGTVVA

SEQ ID NO: 1127 - protein, 7 aa, Artificial Sequence
  Description of Artificial Sequence: Synthetic peptide
WTSTRHT

SEQ ID NO: 1128 - protein, 9 aa, Artificial Sequence
  Description of Artificial Sequence: Synthetic peptide
QQYSSYPYT

SEQ ID NO: 1129 - protein, 7 aa, Artificial Sequence
  Description of Artificial Sequence: Synthetic peptide
GFSLSRY

SEQ ID NO: 1130 - protein, 5 aa, Artificial Sequence
  Description of Artificial Sequence: Synthetic peptide
WGGGS

SEQ ID NO: 1131 - protein, 10 aa, Artificial Sequence
  Description of Artificial Sequence: Synthetic peptide
IYFDNYVGFA

SEQ ID NO: 1132 - protein, 7 aa, Artificial Sequence
  Description of Artificial Sequence: Synthetic peptide
SQDVGTV

SEQ ID NO: 1133 - protein, 3 aa, Artificial Sequence
  Description of Artificial Sequence: Synthetic peptide
WTS

SEQ ID NO: 1134 - protein, 6 aa, Artificial Sequence
  Description of Artificial Sequence: Synthetic peptide
YSSYPY

SEQ ID NO: 1135 - protein, 10 aa, Artificial Sequence
  Description of Artificial Sequence: Synthetic peptide
GFSLSRYSVH

SEQ ID NO: 1136 - protein, 9 aa, Artificial Sequence
  Description of Artificial Sequence: Synthetic peptide
MIWGGGSTD

SEQ ID NO: 1137 - protein, 11 aa, Artificial Sequence
  Description of Artificial Sequence: Synthetic peptide
IYFDNYVGFAY

SEQ ID NO: 1138 - protein, 11 aa, Artificial Sequence
  Description of Artificial Sequence: Synthetic peptide
KASQDVGTVVA

SEQ ID NO: 1139 - protein, 7 aa, Artificial Sequence
  Description of Artificial Sequence: Synthetic peptide
WTSTRHT

SEQ ID NO: 1140 - protein, 9 aa, Artificial Sequence
  Description of Artificial Sequence: Synthetic peptide
QQYSSYPYT

SEQ ID NO: 1141 - protein, 6 aa, Artificial Sequence
  Description of Artificial Sequence: Synthetic peptide
SRYSVH

SEQ ID NO: 1142 - protein, 12 aa, Artificial Sequence
  Description of Artificial Sequence: Synthetic peptide
WLGMIWGGGSTD

SEQ ID NO: 1143 - protein, 12 aa, Artificial Sequence
  Description of Artificial Sequence: Synthetic peptide
ARIYFDNYVGFA

SEQ ID NO: 1144 - protein, 7 aa, Artificial Sequence
  Description of Artificial Sequence: Synthetic peptide
GTVVAWY

SEQ ID NO: 1145 - protein, 10 aa, Artificial Sequence
  Description of Artificial Sequence: Synthetic peptide
LLIFWTSTRH

SEQ ID NO: 1146 - protein, 8 aa, Artificial Sequence
  Description of Artificial Sequence: Synthetic peptide
QQYSSYPY

SEQ ID NO: 1147 - protein, 8 aa, Artificial Sequence
  Description of Artificial Sequence: Synthetic peptide
GFSLSRYS

SEQ ID NO: 1148 - protein, 7 aa, Artificial Sequence
  Description of Artificial Sequence: Synthetic peptide
IWGGGST

SEQ ID NO: 1149 - protein, 13 aa, Artificial Sequence
  Description of Artificial Sequence: Synthetic peptide
ARIYFDNYVGFAY

SEQ ID NO: 1150 - protein, 6 aa, Artificial Sequence
  Description of Artificial Sequence: Synthetic peptide
QDVGTV

SEQ ID NO: 1151 - protein, 3 aa, Artificial Sequence
  Description of Artificial Sequence: Synthetic peptide
WTS

SEQ ID NO: 1152 - protein, 9 aa, Artificial Sequence
  Description of Artificial Sequence: Synthetic peptide
QQYSSYPYT

SEQ ID NO: 1153 - protein, 119 aa, Artificial Sequence
  Description of Artificial Sequence: Synthetic polypeptide
QVQLKESGPGLVAPSQSLSITCTVSGFSLSRYSVHWVRQPPGKGLVWLGMIWGGGSTDYNSALKSRLSISKDNSKSQVFLKMNSLQTDDTAMYYCARIYFDNYVGFAYWGQGTTLTVSS

SEQ ID NO: 1154 - protein, 107 aa, Artificial Sequence
  Description of Artificial Sequence: Synthetic polypeptide
DIVMTQSHKFMSTSVGDRVSITCKASQDVGTVVAWYQQKPGQSPKLLIFWTSTRHTGVPDRFTGSGSGTDFTLTISNVQSEDLADYFCQQYSSYPYTFGSGTKLELK

SEQ ID NO: 1155 - protein, 449 aa, Artificial Sequence
  Description of Artificial Sequence: Synthetic polypeptide
QVQLKESGPGLVAPSQSLSITCTVSGFSLSRYSVHWVRQPPGKGLVWLGMIWGGGSTDYNSALKSRLSISKDNSKSQVFLKMNSLQTDDTAMYYCARIYFDNYVGFAYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1156 - protein, 214 aa, Artificial Sequence
  Description of Artificial Sequence: Synthetic polypeptide
DIVMTQSHKFMSTSVGDRVSITCKASQDVGTVVAWYQQKPGQSPKLLIFWTSTRHTGVPDRFTGSGSGTDFTLTISNVQSEDLADYFCQQYSSYPYTFGSGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1157 - protein, 5 aa, Artificial Sequence
  Description of Artificial Sequence: Synthetic peptide
NYAVH

SEQ ID NO: 1158 - protein, 16 aa, Artificial Sequence
  Description of Artificial Sequence: Synthetic peptide
VIWTDGSTDYNAGFIS

SEQ ID NO: 1159 - protein, 11 aa, Artificial Sequence
  Description of Artificial Sequence: Synthetic peptide
NNGYFPAFFAY

SEQ ID NO: 1160 - protein, 16 aa, Artificial Sequence
  Description of Artificial Sequence: Synthetic peptide
RSSQTIVHSNGNTYLE

SEQ ID NO: 1161 - protein, 7 aa, Artificial Sequence
  Description of Artificial Sequence: Synthetic peptide
KVSNRFS

SEQ ID NO: 1162 - protein, 9 aa, Artificial Sequence
  Description of Artificial Sequence: Synthetic peptide
FQGSHAPFT

SEQ ID NO: 1163 - protein, 7 aa, Artificial Sequence
  Description of Artificial Sequence: Synthetic peptide
GFSLTNY

SEQ ID NO: 1164 - protein, 5 aa, Artificial Sequence
  Description of Artificial Sequence: Synthetic peptide
WTDGS

SEQ ID NO: 1165 - protein, 10 aa, Artificial Sequence
  Description of Artificial Sequence: Synthetic peptide
NNGYFPAFFA

SEQ ID NO: 1166 - protein, 12 aa, Artificial Sequence
  Description of Artificial Sequence: Synthetic peptide
SQTIVHSNGNTY

SEQ ID NO: 1167 - protein, 3 aa, Artificial Sequence
  Description of Artificial Sequence: Synthetic peptide
KVS

SEQ ID NO: 1168 - protein, 6 aa, Artificial Sequence
  Description of Artificial Sequence: Synthetic peptide
GSHAPF

SEQ ID NO: 1169 - protein, 10 aa, Artificial Sequence
  Description of Artificial Sequence: Synthetic peptide
GFSLTNYAVH

SEQ ID NO: 1170 - protein, 9 aa, Artificial Sequence
  Description of Artificial Sequence: Synthetic peptide
VIWTDGSTD

SEQ ID NO: 1171 - protein, 11 aa, Artificial Sequence
  Description of Artificial Sequence: Synthetic peptide
NNGYFPAFFAY

SEQ ID NO: 1172 - protein, 16 aa, Artificial Sequence
  Description of Artificial Sequence: Synthetic peptide
RSSQTIVHSNGNTYLE

SEQ ID NO: 1173 - protein, 7 aa, Artificial Sequence
  Description of Artificial Sequence: Synthetic peptide
KVSNRFS

SEQ ID NO: 1174 - protein, 9 aa, Artificial Sequence
  Description of Artificial Sequence: Synthetic peptide
FQGSHAPFT

SEQ ID NO: 1175 - protein, 6 aa, Artificial Sequence
  Description of Artificial Sequence: Synthetic peptide
TNYAVH

SEQ ID NO: 1176 - protein, 12 aa, Artificial Sequence
  Description of Artificial Sequence: Synthetic peptide
WLGVIWTDGSTD

SEQ ID NO: 1177 - protein, 12 aa, Artificial Sequence
  Description of Artificial Sequence: Synthetic peptide
ARNNGYFPAFFA

SEQ ID NO: 1178 - protein, 12 aa, Artificial Sequence
  Description of Artificial Sequence: Synthetic peptide
VHSNGNTYLEWY

SEQ ID NO: 1179 - protein, 10 aa, Artificial Sequence
  Description of Artificial Sequence: Synthetic peptide
LLMYKVSNRF

SEQ ID NO: 1180 - protein, 8 aa, Artificial Sequence
  Description of Artificial Sequence: Synthetic peptide
FQGSHAPF

SEQ ID NO: 1181 - protein, 8 aa, Artificial Sequence
  Description of Artificial Sequence: Synthetic peptide
GFSLTNYA

SEQ ID NO: 1182 - protein, 7 aa, Artificial Sequence
  Description of Artificial Sequence: Synthetic peptide
IWTDGST

SEQ ID NO: 1183 - protein, 13 aa, Artificial Sequence
  Description of Artificial Sequence: Synthetic peptide
ARNNGYFPAFFAY

SEQ ID NO: 1184 - protein, 11 aa, Artificial Sequence
  Description of Artificial Sequence: Synthetic peptide
QTIVHSNGNTY

SEQ ID NO: 1185 - protein, 3 aa, Artificial Sequence
  Description of Artificial Sequence: Synthetic peptide
KVS

SEQ ID NO: 1186 - protein, 9 aa, Artificial Sequence
  Description of Artificial Sequence: Synthetic peptide
FQGSHAPFT

SEQ ID NO: 1187 - protein, 119 aa, Artificial Sequence
  Description of Artificial Sequence: Synthetic polypeptide
QVQLKESGPGLVAPSQSLSITCTVSGFSLTNYAVHWVRQSPGKGLEWLGVIWTDGSTDYNAGFISRLSISKDNSKSQVFFKMNSLQADDTAIYYCARNNGYFPAFFAYWGQGTTVTVSS

SEQ ID NO: 1188 - protein, 112 aa, Artificial Sequence
  Description of Artificial Sequence: Synthetic polypeptide
DVLMTQTPLSLPVSLGDQASISCRSSQTIVHSNGNTYLEWYLQKPGQSPKLLMYKVSNRFSGVPDRFGGSGSGTDFTLKISRVEAEDLGVYYCFQGSHAPFTFGSGTKLEIK

SEQ ID NO: 1189 - protein, 449 aa, Artificial Sequence
  Description of Artificial Sequence: Synthetic polypeptide
QVQLKESGPGLVAPSQSLSITCTVSGFSLTNYAVHWVRQSPGKGLEWLGVIWTDGSTDYNAGFISRLSISKDNSKSQVFFKMNSLQADDTAIYYCARNNGYFPAFFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1190 - protein, 219 aa, Artificial Sequence
  Description of Artificial Sequence: Synthetic polypeptide
DVLMTQTPLSLPVSLGDQASISCRSSQTIVHSNGNTYLEWYLQKPGQSPKLLMYKVSNRFSGVPDRFGGSGSGTDFTLKISRVEAEDLGVYYCFQGSHAPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1191 - protein, 6 aa, Artificial Sequence
  Description of Artificial Sequence: Synthetic peptide
SGYYWN

SEQ ID NO: 1192 - protein, 16 aa, Artificial Sequence
  Description of Artificial Sequence: Synthetic peptide
YINYDGRNNYNPSLRN

SEQ ID NO: 1193 - protein, 11 aa, Artificial Sequence
  Description of Artificial Sequence: Synthetic peptide
DQGYSKFYFDY

SEQ ID NO: 1194 - protein, 11 aa, Artificial Sequence
  Description of Artificial Sequence: Synthetic peptide
KASEDIYNRLA

SEQ ID NO: 1195 - protein, 7 aa, Artificial Sequence
  Description of Artificial Sequence: Synthetic peptide
GATSLET

SEQ ID NO: 1196 - protein, 9 aa, Artificial Sequence
  Description of Artificial Sequence: Synthetic peptide
QQYWSFPRT

SEQ ID NO: 1197 - protein, 8 aa, Artificial Sequence
  Description of Artificial Sequence: Synthetic peptide
GYSITSGY

SEQ ID NO: 1198 - protein, 5 aa, Artificial Sequence
  Description of Artificial Sequence: Synthetic peptide
NYDGR

SEQ ID NO: 1199 - protein, 10 aa, Artificial Sequence
  Description of Artificial Sequence: Synthetic peptide
DQGYSKFYFD

SEQ ID NO: 1200 - protein, 7 aa, Artificial Sequence
  Description of Artificial Sequence: Synthetic peptide
SEDIYNR

SEQ ID NO: 1201 - protein, 3 aa, Artificial Sequence
  Description of Artificial Sequence: Synthetic peptide
GAT

SEQ ID NO: 1202 - protein, 6 aa, Artificial Sequence
  Description of Artificial Sequence: Synthetic peptide
YWSFPR

SEQ ID NO: 1203 - protein, 11 aa, Artificial Sequence
  Description of Artificial Sequence: Synthetic peptide
GYSITSGYYWN

SEQ ID NO: 1204 - protein, 9 aa, Artificial Sequence
  Description of Artificial Sequence: Synthetic peptide
YINYDGRNN

SEQ ID NO: 1205 - protein, 11 aa, Artificial Sequence
  Description of Artificial Sequence: Synthetic peptide
DQGYSKFYFDY

SEQ ID NO: 1206 - protein, 11 aa, Artificial Sequence
  Description of Artificial Sequence: Synthetic peptide
KASEDIYNRLA

SEQ ID NO: 1207 - protein, 7 aa, Artificial Sequence
  Description of Artificial Sequence: Synthetic peptide
GATSLET

SEQ ID NO: 1208 - protein, 9 aa, Artificial Sequence
  Description of Artificial Sequence: Synthetic peptide
QQYWSFPRT

SEQ ID NO: 1209 - protein, 7 aa, Artificial Sequence
  Description of Artificial Sequence: Synthetic peptide
TSGYYWN

SEQ ID NO: 1210 - protein, 12 aa, Artificial Sequence
  Description of Artificial Sequence: Synthetic peptide
WMGYINYDGRNN

SEQ ID NO: 1211 - protein, 12 aa, Artificial Sequence
  Description of Artificial Sequence: Synthetic peptide
ARDQGYSKFYFD

SEQ ID NO: 1212 - protein, 7 aa, Artificial Sequence
  Description of Artificial Sequence: Synthetic peptide
YNRLAWY

SEQ ID NO: 1213 - protein, 10 aa, Artificial Sequence
  Description of Artificial Sequence: Synthetic peptide
LLISGATSLE

SEQ ID NO: 1214 - protein, 8 aa, Artificial Sequence
  Description of Artificial Sequence: Synthetic peptide
QQYWSFPR

SEQ ID NO: 1215 - protein, 9 aa, Artificial Sequence
  Description of Artificial Sequence: Synthetic peptide
GYSITSGYY

SEQ ID NO: 1216 - protein, 7 aa, Artificial Sequence
  Description of Artificial Sequence: Synthetic peptide
INYDGRN

SEQ ID NO: 1217 - protein, 13 aa, Artificial Sequence
  Description of Artificial Sequence: Synthetic peptide
ARDQGYSKFYFDY

SEQ ID NO: 1218 - protein, 6 aa, Artificial Sequence
  Description of Artificial Sequence: Synthetic peptide
EDIYNR

SEQ ID NO: 1219 - protein, 3 aa, Artificial Sequence
  Description of Artificial Sequence: Synthetic peptide
GAT

SEQ ID NO: 1220 - protein, 9 aa, Artificial Sequence
  Description of Artificial Sequence: Synthetic peptide
QQYWSFPRT

SEQ ID NO: 1221 - protein, 120 aa, Artificial Sequence
  Description of Artificial Sequence: Synthetic polypeptide
QVQLKESGPGLVKPSQSLSLTCSVTGYSITSGYYWNWIRQFPGNKLEWMGYINYDGRNNYNPSLRNRISITRDTSKNHFFLKLNSVTTEDTATYYCARDQGYSKFYFDYWGQGTTLTVSS

SEQ ID NO: 1222 - protein, 107 aa, Artificial Sequence
  Description of Artificial Sequence: Synthetic polypeptide
DIQMTQSSSSFSVSLGDRVTITCKASEDIYNRLAWYQQRPGNAPRLLISGATSLETGVPSRFSGSGSGKDYTLSITSLQTEDVANYYCQQYWSFPRTFGGGTKLEIK

SEQ ID NO: 1223 - protein, 450 aa, Artificial Sequence
  Description of Artificial Sequence: Synthetic polypeptide
QVQLKESGPGLVKPSQSLSLTCSVTGYSITSGYYWNWIRQFPGNKLEWMGYINYDGRNNYNPSLRNRISITRDTSKNHFFLKLNSVTTEDTATYYCARDQGYSKFYFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1224 - protein, 214 aa, Artificial Sequence
  Description of Artificial Sequence: Synthetic polypeptide
DIQMTQSSSSFSVSLGDRVTITCKASEDIYNRLAWYQQRPGNAPRLLISGATSLETGVPSRFSGSGSGKDYTLSITSLQTEDVANYYCQQYWSFPRTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1225 - protein, 5 aa, Artificial Sequence
  Description of Artificial Sequence: Synthetic peptide
AYYMH

SEQ ID NO: 1226 - protein, 17 aa, Artificial Sequence
  Description of Artificial Sequence: Synthetic peptide
EINPSAGGTTYNQKFKA

SEQ ID NO: 1227 - protein, 7 aa, Artificial Sequence
  Description of Artificial Sequence: Synthetic peptide
WTNPFDY

SEQ ID NO: 1228 - protein, 11 aa, Artificial Sequence
  Description of Artificial Sequence: Synthetic peptide
KASQNVGTAVA

SEQ ID NO: 1229 - protein, 7 aa, Artificial Sequence
  Description of Artificial Sequence: Synthetic peptide
SASYRYT

SEQ ID NO: 1230 - protein, 8 aa, Artificial Sequence
  Description of Artificial Sequence: Synthetic peptide
QQYNNYLT

SEQ ID NO: 1231 - protein, 7 aa, Artificial Sequence
  Description of Artificial Sequence: Synthetic peptide
GYSFTAY

SEQ ID NO: 1232 - protein, 6 aa, Artificial Sequence
  Description of Artificial Sequence: Synthetic peptide
NPSAGG

SEQ ID NO: 1233 - protein, 6 aa, Artificial Sequence
  Description of Artificial Sequence: Synthetic peptide
WTNPFD

SEQ ID NO: 1234 - protein, 7 aa, Artificial Sequence
  Description of Artificial Sequence: Synthetic peptide
SQNVGTA

SEQ ID NO: 1235 - protein, 3 aa, Artificial Sequence
  Description of Artificial Sequence: Synthetic peptide
SAS

SEQ ID NO: 1236 - protein, 5 aa, Artificial Sequence
  Description of Artificial Sequence: Synthetic peptide
YNNYL

SEQ ID NO: 1237 - protein, 10 aa, Artificial Sequence
  Description of Artificial Sequence: Synthetic peptide
GYSFTAYYMH

SEQ ID NO: 1238 - protein, 10 aa, Artificial Sequence
  Description of Artificial Sequence: Synthetic peptide
EINPSAGGTT

SEQ ID NO: 1239 - protein, 7 aa, Artificial Sequence
  Description of Artificial Sequence: Synthetic peptide
WTNPFDY

SEQ ID NO: 1240 - protein, 11 aa, Artificial Sequence
  Description of Artificial Sequence: Synthetic peptide
KASQNVGTAVA

SEQ ID NO: 1241 - protein, 7 aa, Artificial Sequence
  Description of Artificial Sequence: Synthetic peptide
SASYRYT

SEQ ID NO: 1242 - protein, 8 aa, Artificial Sequence
  Description of Artificial Sequence: Synthetic peptide
QQYNNYLT

SEQ ID NO: 1243 - protein, 6 aa, Artificial Sequence
  Description of Artificial Sequence: Synthetic peptide
TAYYMH

SEQ ID NO: 1244 - protein, 13 aa, Artificial Sequence
  Description of Artificial Sequence: Synthetic peptide
WIGEINPSAGGTT

SEQ ID NO: 1245 - protein, 8 aa, Artificial Sequence
  Description of Artificial Sequence: Synthetic peptide
ARWTNPFD

SEQ ID NO: 1246 - protein, 7 aa, Artificial Sequence
  Description of Artificial Sequence: Synthetic peptide
GTAVAWY

SEQ ID NO: 1247 - protein, 10 aa, Artificial Sequence
  Description of Artificial Sequence: Synthetic peptide
LLIYSASYRY

SEQ ID NO: 1248 - protein, 7 aa, Artificial Sequence
  Description of Artificial Sequence: Synthetic peptide
QQYNNYL

SEQ ID NO: 1249 - protein, 8 aa, Artificial Sequence
  Description of Artificial Sequence: Synthetic peptide
GYSFTAYY

SEQ ID NO: 1250 - protein, 8 aa, Artificial Sequence
  Description of Artificial Sequence: Synthetic peptide
INPSAGGT

SEQ ID NO: 1251 - protein, 9 aa, Artificial Sequence
  Description of Artificial Sequence: Synthetic peptide
ARWTNPFDY

SEQ ID NO: 1252 - protein, 6 aa, Artificial Sequence
  Description of Artificial Sequence: Synthetic peptide
QNVGTA

SEQ ID NO: 1253 - protein, 3 aa, Artificial Sequence
  Description of Artificial Sequence: Synthetic peptide
SAS

SEQ ID NO: 1254 - protein, 8 aa, Artificial Sequence
  Description of Artificial Sequence: Synthetic peptide
QQYNNYLT

SEQ ID NO: 1255 - protein, 116 aa, Artificial Sequence
  Description of Artificial Sequence: Synthetic polypeptide
QVQLKESGPELKKPGETVKISCKASGYSFTAYYMHWVKQSPEKSLEWIGEINPSAGGTTYNQKFKAKATLTVDKSSSTAFIQLKSLTSEDSAVYYCARWTNPFDYWGQGTTLTVSS

SEQ ID NO: 1256 - protein, 106 aa, Artificial Sequence
  Description of Artificial Sequence: Synthetic polypeptide
DIVMTQSQKFMSTTVGDRVSITCKASQNVGTAVAWYQQKPGQSPKLLIYSASYRYTGVPDRFTGSGSGTHFTLTISNIQSEDLADYFCQQYNNYLTFGSGTKLEIK

SEQ ID NO: 1257 - protein, 446 aa, Artificial Sequence
  Description of Artificial Sequence: Synthetic polypeptide
QVQLKESGPELKKPGETVKISCKASGYSFTAYYMHWVKQSPEKSLEWIGEINPSAGGTTYNQKFKAKATLTVDKSSSTAFIQLKSLTSEDSAVYYCARWTNPFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1258 - protein, 213 aa, Artificial Sequence
  Description of Artificial Sequence: Synthetic polypeptide
DIVMTQSQKFMSTTVGDRVSITCKASQNVGTAVAWYQQKPGQSPKLLIYSASYRYTGVPDRFTGSGSGTHFTLTISNIQSEDLADYFCQQYNNYLTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1259 - protein, 5 aa, Artificial Sequence
  Description of Artificial Sequence: Synthetic peptide
SYWIN

SEQ ID NO: 1260 - protein, 17 aa, Artificial Sequence
  Description of Artificial Sequence: Synthetic peptide
NIYPGSSSTNYNEKFKS

SEQ ID NO: 1261 - protein, 13 aa, Artificial Sequence
  Description of Artificial Sequence: Synthetic peptide
ELGPYYRYSAMVY

SEQ ID NO: 1262 - protein, 11 aa, Artificial Sequence
  Description of Artificial Sequence: Synthetic peptide
KASQNVGTAVA

SEQ ID NO: 1263 - protein, 7 aa, Artificial Sequence
  Description of Artificial Sequence: Synthetic peptide
SASNRYT

SEQ ID NO: 1264 - protein, 9 aa, Artificial Sequence
  Description of Artificial Sequence: Synthetic peptide
QQYSSYPFT

SEQ ID NO: 1265 - protein, 7 aa, Artificial Sequence
  Description of Artificial Sequence: Synthetic peptide
GYTFTSY

SEQ ID NO: 1266 - protein, 6 aa, Artificial Sequence
  Description of Artificial Sequence: Synthetic peptide
YPGSSS

SEQ ID NO: 1267 - protein, 12 aa, Artificial Sequence
  Description of Artificial Sequence: Synthetic peptide
ELGPYYRYSAMV

SEQ ID NO: 1268 - protein, 7 aa, Artificial Sequence
  Description of Artificial Sequence: Synthetic peptide
SQNVGTA

SEQ ID NO: 1269 - protein, 3 aa, Artificial Sequence
  Description of Artificial Sequence: Synthetic peptide
SAS

SEQ ID NO: 1270 - protein, 6 aa, Artificial Sequence
  Description of Artificial Sequence: Synthetic peptide
YSSYPF

SEQ ID NO: 1271 - protein, 10 aa, Artificial Sequence
  Description of Artificial Sequence: Synthetic peptide
GYTFTSYWIN

SEQ ID NO: 1272 - protein, 10 aa, Artificial Sequence
  Description of Artificial Sequence: Synthetic peptide
NIYPGSSSTN

SEQ ID NO: 1273 - protein, 13 aa, Artificial Sequence
  Description of Artificial Sequence: Synthetic peptide
ELGPYYRYSAMVY

SEQ ID NO: 1274 - protein, 11 aa, Artificial Sequence
  Description of Artificial Sequence: Synthetic peptide
KASQNVGTAVA

SEQ ID NO: 1275 - protein, 7 aa, Artificial Sequence
  Description of Artificial Sequence: Synthetic peptide
SASNRYT

SEQ ID NO: 1276 - protein, 9 aa, Artificial Sequence
  Description of Artificial Sequence: Synthetic peptide
QQYSSYPFT

SEQ ID NO: 1277 - protein, 6 aa, Artificial Sequence
  Description of Artificial Sequence: Synthetic peptide
TSYWIN

SEQ ID NO: 1278 - protein, 13 aa, Artificial Sequence
  Description of Artificial Sequence: Synthetic peptide
WIGNIYPGSSSTN

SEQ ID NO: 1279 - protein, 14 aa, Artificial Sequence
  Description of Artificial Sequence: Synthetic peptide
ARELGPYYRYSAMV

SEQ ID NO: 1280 - protein, 7 aa, Artificial Sequence
  Description of Artificial Sequence: Synthetic peptide
GTAVAWY

SEQ ID NO: 1281 - protein, 10 aa, Artificial Sequence
  Description of Artificial Sequence: Synthetic peptide
LLIYSASNRY

SEQ ID NO: 1282 - protein, 8 aa, Artificial Sequence
  Description of Artificial Sequence: Synthetic peptide
QQYSSYPF

SEQ ID NO: 1283 - protein, 8 aa, Artificial Sequence
  Description of Artificial Sequence: Synthetic peptide
GYTFTSYW

SEQ ID NO: 1284 - protein, 8 aa, Artificial Sequence
  Description of Artificial Sequence: Synthetic peptide
IYPGSSST

SEQ ID NO: 1285 - protein, 15 aa, Artificial Sequence
  Description of Artificial Sequence: Synthetic peptide
ARELGPYYRYSAMVY

SEQ ID NO: 1286 - protein, 6 aa, Artificial Sequence
  Description of Artificial Sequence: Synthetic peptide
QNVGTA

SEQ ID NO: 1287 - protein, 3 aa, Artificial Sequence
  Description of Artificial Sequence: Synthetic peptide
SAS

SEQ ID NO: 1288 - protein, 9 aa, Artificial Sequence
  Description of Artificial Sequence: Synthetic peptide
QQYSSYPFT

SEQ ID NO: 1289 - protein, 122 aa, Artificial Sequence
  Description of Artificial Sequence: Synthetic polypeptide
QVQLQQPGAELVKPGASVKLSCKASGYTFTSYWINWVKQRPGQGLEWIGNIYPGSSSTNYNEKFKSKATLTVDTSSSAAYMQLSSLTSGDSAVYYCARELGPYYRYSAMVYWGQGTTVTVSS

SEQ ID NO: 1290 - protein, 107 aa, Artificial Sequence
  Description of Artificial Sequence: Synthetic polypeptide
DIVMTQSQKFMSTTVGDRVSITCKASQNVGTAVAWYQQKPGQSPKLLIYSASNRYTGVPDRFTGSGSGTDFTLTISNMQSEDLADYFCQQYSSYPFTFGSGTKLEIK

SEQ ID NO: 1291 - protein, 452 aa, Artificial Sequence
  Description of Artificial Sequence: Synthetic polypeptide
QVQLQQPGAELVKPGASVKLSCKASGYTFTSYWINWVKQRPGQGLEWIGNIYPGSSSTNYNEKFKSKATLTVDTSSSAAYMQLSSLTSGDSAVYYCARELGPYYRYSAMVYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1292 - protein, 214 aa, Artificial Sequence
  Description of Artificial Sequence: Synthetic polypeptide
DIVMTQSQKFMSTTVGDRVSITCKASQNVGTAVAWYQQKPGQSPKLLIYSASNRYTGVPDRFTGSGSGTDFTLTISNMQSEDLADYFCQQYSSYPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1293 - protein, 5 aa, Artificial Sequence
  Description of Artificial Sequence: Synthetic peptide
NYWMH

SEQ ID NO: 1294 - protein, 17 aa, Artificial Sequence
  Description of Artificial Sequence: Synthetic peptide
NIDPSDSETHYNQKFKD

SEQ ID NO: 1295 - protein, 8 aa, Artificial Sequence
  Description of Artificial Sequence: Synthetic peptide
GLTGTGHY

SEQ ID NO: 1296 - protein, 11 aa, Artificial Sequence
  Description of Artificial Sequence: Synthetic peptide
RASQDINIYLN

SEQ ID NO: 1297 - protein, 7 aa, Artificial Sequence
  Description of Artificial Sequence: Synthetic peptide
HTSRLHS

SEQ ID NO: 1298 - protein, 9 aa, Artificial Sequence
  Description of Artificial Sequence: Synthetic peptide
QQDNTLPYT

SEQ ID NO: 1299 - protein, 7 aa, Artificial Sequence
  Description of Artificial Sequence: Synthetic peptide
GYTFTNY

SEQ ID NO: 1300 - protein, 6 aa, Artificial Sequence
  Description of Artificial Sequence: Synthetic peptide
DPSDSE

SEQ ID NO: 1301 - protein, 7 aa, Artificial Sequence
  Description of Artificial Sequence: Synthetic peptide
GLTGTGH

SEQ ID NO: 1302 - protein, 7 aa, Artificial Sequence
  Description of Artificial Sequence: Synthetic peptide
SQDINIY

SEQ ID NO: 1303 - protein, 3 aa, Artificial Sequence
  Description of Artificial Sequence: Synthetic peptide
HTS

SEQ ID NO: 1304 - protein, 6 aa, Artificial Sequence
  Description of Artificial Sequence: Synthetic peptide
DNTLPY

SEQ ID NO: 1305 - protein, 10 aa, Artificial Sequence
  Description of Artificial Sequence: Synthetic peptide
GYTFTNYWMH

SEQ ID NO: 1306 - protein, 10 aa, Artificial Sequence
  Description of Artificial Sequence: Synthetic peptide
NIDPSDSETH

SEQ ID NO: 1307 - protein, 8 aa, Artificial Sequence
  Description of Artificial Sequence: Synthetic peptide
GLTGTGHY

SEQ ID NO: 1308 - protein, 11 aa, Artificial Sequence
  Description of Artificial Sequence: Synthetic peptide
RASQDINIYLN

SEQ ID NO: 1309 - protein, 7 aa, Artificial Sequence
  Description of Artificial Sequence: Synthetic peptide
HTSRLHS

SEQ ID NO: 1310 - protein, 9 aa, Artificial Sequence
  Description of Artificial Sequence: Synthetic peptide
QQDNTLPYT

SEQ ID NO: 1311 - protein, 6 aa, Artificial Sequence
  Description of Artificial Sequence: Synthetic peptide
TNYWMH

SEQ ID NO: 1312 - protein, 13 aa, Artificial Sequence
  Description of Artificial Sequence: Synthetic peptide
WIGNIDPSDSETH

SEQ ID NO: 1313 - protein, 9 aa, Artificial Sequence
  Description of Artificial Sequence: Synthetic peptide
ASGLTGTGH

SEQ ID NO: 1314 - protein, 7 aa, Artificial Sequence
  Description of Artificial Sequence: Synthetic peptide
NIYLNWY

SEQ ID NO: 1315 - protein, 10 aa, Artificial Sequence
  Description of Artificial Sequence: Synthetic peptide
CLIYHTSRLH

SEQ ID NO: 1316 - protein, 8 aa, Artificial Sequence
  Description of Artificial Sequence: Synthetic peptide
QQDNTLPY

SEQ ID NO: 1317 - protein, 8 aa, Artificial Sequence
  Description of Artificial Sequence: Synthetic peptide
GYTFTNYW

SEQ ID NO: 1318 - protein, 8 aa, Artificial Sequence
  Description of Artificial Sequence: Synthetic peptide
IDPSDSET

SEQ ID NO: 1319 - protein, 10 aa, Artificial Sequence
  Description of Artificial Sequence: Synthetic peptide
ASGLTGTGHY

SEQ ID NO: 1320 - protein, 6 aa, Artificial Sequence
  Description of Artificial Sequence: Synthetic peptide
QDINIY

SEQ ID NO: 1321 - protein, 3 aa, Artificial Sequence
  Description of Artificial Sequence: Synthetic peptide
HTS

SEQ ID NO: 1322 - protein, 9 aa, Artificial Sequence
  Description of Artificial Sequence: Synthetic peptide
QQDNTLPYT

SEQ ID NO: 1323 - protein, 117 aa, Artificial Sequence
  Description of Artificial Sequence: Synthetic polypeptide
EVKLVESGAELVKPGASVKLSCKASGYTFTNYWMHWVKQRPGQGLEWIGNIDPSDSETHYNQKFKDKATLTVDKSSSTAYMQLSSLTSEDSAVYYCASGLTGTGHYWGQGTTLTVSS

SEQ ID NO: 1324 - protein, 107 aa, Artificial Sequence
  Description of Artificial Sequence: Synthetic polypeptide
DIQMTQTTSSLSASLGDRVTITCRASQDINIYLNWYQQKPEGSIKCLIYHTSRLHSGVPSRFSGSGSGTDYSLTISNLEQEDIATYFCQQDNTLPYTFGSGTKLEIK

SEQ ID NO: 1325 - protein, 447 aa, Artificial Sequence
  Description of Artificial Sequence: Synthetic polypeptide
EVKLVESGAELVKPGASVKLSCKASGYTFTNYWMHWVKQRPGQGLEWIGNIDPSDSETHYNQKFKDKATLTVDKSSSTAYMQLSSLTSEDSAVYYCASGLTGTGHYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1326 - protein, 214 aa, Artificial Sequence
  Description of Artificial Sequence: Synthetic polypeptide
DIQMTQTTSSLSASLGDRVTITCRASQDINIYLNWYQQKPEGSIKCLIYHTSRLHSGVPSRFSGSGSGTDYSLTISNLEQEDIATYFCQQDNTLPYTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1327 - protein, 5 aa, Artificial Sequence
  Description of Artificial Sequence: Synthetic peptide
DYSMD

SEQ ID NO: 1328 - protein, 17 aa, Artificial Sequence
  Description of Artificial Sequence: Synthetic peptide
YIYTYSGGAGYNRKFKS

SEQ ID NO: 1329 - protein, 9 aa, Artificial Sequence
  Description of Artificial Sequence: Synthetic peptide
DSSDYEFAY

SEQ ID NO: 1330 - protein, 11 aa, Artificial Sequence
  Description of Artificial Sequence: Synthetic peptide
KASQDIKSYLS

SEQ ID NO: 1331 - protein, 7 aa, Artificial Sequence
  Description of Artificial Sequence: Synthetic peptide
RANRLVD

SEQ ID NO: 1332 - protein, 8 aa, Artificial Sequence
  Description of Artificial Sequence: Synthetic peptide
LQYDEFRT

SEQ ID NO: 1333 - protein, 7 aa, Artificial Sequence
  Description of Artificial Sequence: Synthetic peptide
GYTFTDY

SEQ ID NO: 1334 - protein, 6 aa, Artificial Sequence
  Description of Artificial Sequence: Synthetic peptide
YTYSGG

SEQ ID NO: 1335 - protein, 8 aa, Artificial Sequence
  Description of Artificial Sequence: Synthetic peptide
DSSDYEFA

SEQ ID NO: 1336 - protein, 7 aa, Artificial Sequence
  Description of Artificial Sequence: Synthetic peptide
SQDIKSY

SEQ ID NO: 1337 - protein, 3 aa, Artificial Sequence
  Description of Artificial Sequence: Synthetic peptide
RAN

SEQ ID NO: 1338 - protein, 5 aa, Artificial Sequence
  Description of Artificial Sequence: Synthetic peptide
YDEFR

SEQ ID NO: 1339 - protein, 10 aa, Artificial Sequence
  Description of Artificial Sequence: Synthetic peptide
GYTFTDYSMD

SEQ ID NO: 1340 - protein, 10 aa, Artificial Sequence
  Description of Artificial Sequence: Synthetic peptide
YIYTYSGGAG

SEQ ID NO: 1341 - protein, 9 aa, Artificial Sequence
  Description of Artificial Sequence: Synthetic peptide
DSSDYEFAY

SEQ ID NO: 1342 - protein, 11 aa, Artificial Sequence
  Description of Artificial Sequence: Synthetic peptide
KASQDIKSYLS

SEQ ID NO: 1343 - protein, 7 aa, Artificial Sequence
  Description of Artificial Sequence: Synthetic peptide
RANRLVD

SEQ ID NO: 1344 - protein, 8 aa, Artificial Sequence
  Description of Artificial Sequence: Synthetic peptide
LQYDEFRT

SEQ ID NO: 1345 - protein, 6 aa, Artificial Sequence
  Description of Artificial Sequence: Synthetic peptide
TDYSMD

SEQ ID NO: 1346 - protein, 13 aa, Artificial Sequence
  Description of Artificial Sequence: Synthetic peptide
WIGYIYTYSGGAG

SEQ ID NO: 1347 - protein, 10 aa, Artificial Sequence
  Description of Artificial Sequence: Synthetic peptide
ARDSSDYEFA

SEQ ID NO: 1348 - protein, 7 aa, Artificial Sequence
  Description of Artificial Sequence: Synthetic peptide
KSYLSWF

SEQ ID NO: 1349 - protein, 10 aa, Artificial Sequence
  Description of Artificial Sequence: Synthetic peptide
TLIYRANRLV

SEQ ID NO: 1350 - protein, 7 aa, Artificial Sequence
  Description of Artificial Sequence: Synthetic peptide
LQYDEFR

SEQ ID NO: 1351 - protein, 8 aa, Artificial Sequence
  Description of Artificial Sequence: Synthetic peptide
GYTFTDYS

SEQ ID NO: 1352 - protein, 8 aa, Artificial Sequence
  Description of Artificial Sequence: Synthetic peptide
IYTYSGGA

SEQ ID NO: 1353 - protein, 11 aa, Artificial Sequence
  Description of Artificial Sequence: Synthetic peptide
ARDSSDYEFAY

SEQ ID NO: 1354 - protein, 6 aa, Artificial Sequence
  Description of Artificial Sequence: Synthetic peptide
QDIKSY

SEQ ID NO: 1355 - protein, 3 aa, Artificial Sequence
  Description of Artificial Sequence: Synthetic peptide
RAN

SEQ ID NO: 1356 - protein, 8 aa, Artificial Sequence
  Description of Artificial Sequence: Synthetic peptide
LQYDEFRT

SEQ ID NO: 1357 - protein, 118 aa, Artificial Sequence
  Description of Artificial Sequence: Synthetic polypeptide
EFQLQQSGPELVKPGASLKISCKASGYTFTDYSMDWVKQSHGKTLEWIGYIYTYSGGAGYNRKFKSKATLTVDKSSSTAYLELHSLTSDDSAVYYCARDSSDYEFAYWGQGTLVTVSA

SEQ ID NO: 1358 - protein, 106 aa, Artificial Sequence
  Description of Artificial Sequence: Synthetic polypeptide
DIKMTQSPSSMCPSLGERVTITCKASQDIKSYLSWFQQKPGKSPKTLIYRANRLVDGVPSRFSGSGSGQDYSLTISSLEYEDMGIYYCLQYDEFRTFGGGTKLEIK

SEQ ID NO: 1359 - protein, 448 aa, Artificial Sequence
  Description of Artificial Sequence: Synthetic polypeptide
EFQLQQSGPELVKPGASLKISCKASGYTFTDYSMDWVKQSHGKTLEWIGYIYTYSGGAGYNRKFKSKATLTVDKSSSTAYLELHSLTSDDSAVYYCARDSSDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1360 - protein, 213 aa, Artificial Sequence
  Description of Artificial Sequence: Synthetic polypeptide
DIKMTQSPSSMCPSLGERVTITCKASQDIKSYLSWFQQKPGKSPKTLIYRANRLVDGVPSRFSGSGSGQDYSLTISSLEYEDMGIYYCLQYDEFRTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1361 - protein, 7 aa, Artificial Sequence
  Description of Artificial Sequence: Synthetic peptide
TSGMGVS

SEQ ID NO: 1362 - protein, 16 aa, Artificial Sequence
  Description of Artificial Sequence: Synthetic peptide
HIFWDDDKRYNPSLKS

SEQ ID NO: 1363 - protein, 12 aa, Artificial Sequence
  Description of Artificial Sequence: Synthetic peptide
RDGYGDYAYFDV

SEQ ID NO: 1364 - protein, 11 aa, Artificial Sequence
  Description of Artificial Sequence: Synthetic peptide
RASENIYSDLA

SEQ ID NO: 1365 - protein, 7 aa, Artificial Sequence
  Description of Artificial Sequence: Synthetic peptide
AATILTD

SEQ ID NO: 1366 - protein, 9 aa, Artificial Sequence
  Description of Artificial Sequence: Synthetic peptide
QHFWGTPWT

SEQ ID NO: 1367 - protein, 9 aa, Artificial Sequence
  Description of Artificial Sequence: Synthetic peptide
GFSLNTSGM

SEQ ID NO: 1368 - protein, 5 aa, Artificial Sequence
  Description of Artificial Sequence: Synthetic peptide
FWDDD

SEQ ID NO: 1369 - protein, 11 aa, Artificial Sequence
  Description of Artificial Sequence: Synthetic peptide
RDGYGDYAYFD

SEQ ID NO: 1370 - protein, 7 aa, Artificial Sequence
  Description of Artificial Sequence: Synthetic peptide
SENIYSD

SEQ ID NO: 1371 - protein, 3 aa, Artificial Sequence
  Description of Artificial Sequence: Synthetic peptide
AAT

SEQ ID NO: 1372 - protein, 6 aa, Artificial Sequence
  Description of Artificial Sequence: Synthetic peptide
FWGTPW

SEQ ID NO: 1373 - protein, 12 aa, Artificial Sequence
  Description of Artificial Sequence: Synthetic peptide
GFSLNTSGMGVS

SEQ ID NO: 1374 - protein, 9 aa, Artificial Sequence
  Description of Artificial Sequence: Synthetic peptide
HIFWDDDKR

SEQ ID NO: 1375 - protein, 12 aa, Artificial Sequence
  Description of Artificial Sequence: Synthetic peptide
RDGYGDYAYFDV

SEQ ID NO: 1376 - protein, 11 aa, Artificial Sequence
  Description of Artificial Sequence: Synthetic peptide
RASENIYSDLA

SEQ ID NO: 1377 - protein, 7 aa, Artificial Sequence
  Description of Artificial Sequence: Synthetic peptide
AATILTD

SEQ ID NO: 1378 - protein, 9 aa, Artificial Sequence
  Description of Artificial Sequence: Synthetic peptide
QHFWGTPWT

SEQ ID NO: 1379 - protein, 8 aa, Artificial Sequence
  Description of Artificial Sequence: Synthetic peptide
NTSGMGVS

SEQ ID NO: 1380 - protein, 12 aa, Artificial Sequence
  Description of Artificial Sequence: Synthetic peptide
WLAHIFWDDDKR

SEQ ID NO: 1381 - protein, 13 aa, Artificial Sequence
  Description of Artificial Sequence: Synthetic peptide
ARRDGYGDYAYFD

SEQ ID NO: 1382 - protein, 7 aa, Artificial Sequence
  Description of Artificial Sequence: Synthetic peptide
YSDLAWY

SEQ ID NO: 1383 - protein, 10 aa, Artificial Sequence
  Description of Artificial Sequence: Synthetic peptide
LLVYAATILT

SEQ ID NO: 1384 - protein, 8 aa, Artificial Sequence
  Description of Artificial Sequence: Synthetic peptide
QHFWGTPW

SEQ ID NO: 1385 - protein, 10 aa, Artificial Sequence
  Description of Artificial Sequence: Synthetic peptide
GFSLNTSGMG

SEQ ID NO: 1386 - protein, 7 aa, Artificial Sequence
  Description of Artificial Sequence: Synthetic peptide
IFWDDDK

SEQ ID NO: 1387 - protein, 14 aa, Artificial Sequence
  Description of Artificial Sequence: Synthetic peptide
ARRDGYGDYAYFDV

SEQ ID NO: 1388 - protein, 6 aa, Artificial Sequence
  Description of Artificial Sequence: Synthetic peptide
ENIYSD

SEQ ID NO: 1389 - protein, 3 aa, Artificial Sequence
  Description of Artificial Sequence: Synthetic peptide
AAT

SEQ ID NO: 1390 - protein, 9 aa, Artificial Sequence
  Description of Artificial Sequence: Synthetic peptide
QHFWGTPWT

SEQ ID NO: 1391 - protein, 122 aa, Artificial Sequence
  Description of Artificial Sequence: Synthetic polypeptide
QVTLKESGPGILQPSQTLSLTCSFSGFSLNTSGMGVSWIRKPSGKGLEWLAHIFWDDDKRYNPSLKSRLTISKDTSSNQVFLMITSVDTADTATYYCARRDGYGDYAYFDVWGAGTLVTVSA

SEQ ID NO: 1392 - protein, 107 aa, Artificial Sequence
  Description of Artificial Sequence: Synthetic polypeptide
DIQMTQSPASLSVSVGETVTITCRASENIYSDLAWYQQKQGKSPQLLVYAATILTDGVPSRFSGSGSGTQYSLKINSLQSEDFGNYYCQHFWGTPWTFGDGTRLEIK

SEQ ID NO: 1393 - protein, 452 aa, Artificial Sequence
  Description of Artificial Sequence: Synthetic polypeptide
QVTLKESGPGILQPSQTLSLTCSFSGFSLNTSGMGVSWIRKPSGKGLEWLAHIFWDDDKRYNPSLKSRLTISKDTSSNQVFLMITSVDTADTATYYCARRDGYGDYAYFDVWGAGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1394 - protein, 214 aa, Artificial Sequence
  Description of Artificial Sequence: Synthetic polypeptide
DIQMTQSPASLSVSVGETVTITCRASENIYSDLAWYQQKQGKSPQLLVYAATILTDGVPSRFSGSGSGTQYSLKINSLQSEDFGNYYCQHFWGTPWTFGDGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1395 - protein, 5 aa, Artificial Sequence
  Description of Artificial Sequence: Synthetic peptide
SHWIH

SEQ ID NO: 1396 - protein, 17 aa, Artificial Sequence
  Description of Artificial Sequence: Synthetic peptide
NIYPGSSSTNYNEKFKR

SEQ ID NO: 1397 - protein, 12 aa, Artificial Sequence
  Description of Artificial Sequence: Synthetic peptide
HSPGHRDYAMDY

SEQ ID NO: 1398 - protein, 11 aa, Artificial Sequence
  Description of Artificial Sequence: Synthetic peptide
KASQNVGTAVA

SEQ ID NO: 1399 - protein, 7 aa, Artificial Sequence
  Description of Artificial Sequence: Synthetic peptide
SASNRYT

SEQ ID NO: 1400 - protein, 9 aa, Artificial Sequence
  Description of Artificial Sequence: Synthetic peptide
QQYSTYPLT

SEQ ID NO: 1401 - protein, 7 aa, Artificial Sequence
  Description of Artificial Sequence: Synthetic peptide
GYTSTSH

SEQ ID NO: 1402 - protein, 6 aa, Artificial Sequence
  Description of Artificial Sequence: Synthetic peptide
YPGSSS

SEQ ID NO: 1403 - protein, 11 aa, Artificial Sequence
  Description of Artificial Sequence: Synthetic peptide
HSPGHRDYAMD

SEQ ID NO: 1404 - protein, 7 aa, Artificial Sequence
  Description of Artificial Sequence: Synthetic peptide
SQNVGTA

SEQ ID NO: 1405 - protein, 3 aa, Artificial Sequence
  Description of Artificial Sequence: Synthetic peptide
SAS

SEQ ID NO: 1406 - protein, 6 aa, Artificial Sequence
  Description of Artificial Sequence: Synthetic peptide
YSTYPL

SEQ ID NO: 1407 - protein, 10 aa, Artificial Sequence
  Description of Artificial Sequence: Synthetic peptide
GYTSTSHWIH

SEQ ID NO: 1408 - protein, 10 aa, Artificial Sequence
  Description of Artificial Sequence: Synthetic peptide
NIYPGSSSTN

SEQ ID NO: 1409 - protein, 12 aa, Artificial Sequence
  Description of Artificial Sequence: Synthetic peptide
HSPGHRDYAMDY

SEQ ID NO: 1410 - protein, 11 aa, Artificial Sequence
  Description of Artificial Sequence: Synthetic peptide
KASQNVGTAVA

SEQ ID NO: 1411 - protein, 7 aa, Artificial Sequence
  Description of Artificial Sequence: Synthetic peptide
SASNRYT

SEQ ID NO: 1412 - protein, 9 aa, Artificial Sequence
  Description of Artificial Sequence: Synthetic peptide
QQYSTYPLT

SEQ ID NO: 1413 - protein, 6 aa, Artificial Sequence
  Description of Artificial Sequence: Synthetic peptide
TSHWIH

SEQ ID NO: 1414 - protein, 13 aa, Artificial Sequence
  Description of Artificial Sequence: Synthetic peptide
WIGNIYPGSSSTN

SEQ ID NO: 1415 - protein, 13 aa, Artificial Sequence
  Description of Artificial Sequence: Synthetic peptide
ARHSPGHRDYAMD

SEQ ID NO: 1416 - protein, 7 aa, Artificial Sequence
  Description of Artificial Sequence: Synthetic peptide
GTAVAWY

SEQ ID NO: 1417 - protein, 10 aa, Artificial Sequence
  Description of Artificial Sequence: Synthetic peptide
LLIASASNRY

SEQ ID NO: 1418 - protein, 8 aa, Artificial Sequence
  Description of Artificial Sequence: Synthetic peptide
QQYSTYPL

SEQ ID NO: 1419 - protein, 8 aa, Artificial Sequence
  Description of Artificial Sequence: Synthetic peptide
GYTSTSHW

SEQ ID NO: 1420 - protein, 8 aa, Artificial Sequence
  Description of Artificial Sequence: Synthetic peptide
IYPGSSST

SEQ ID NO: 1421 - protein, 14 aa, Artificial Sequence
  Description of Artificial Sequence: Synthetic peptide
ARHSPGHRDYAMDY

SEQ ID NO: 1422 - protein, 6 aa, Artificial Sequence
  Description of Artificial Sequence: Synthetic peptide
QNVGTA

SEQ ID NO: 1423 - protein, 3 aa, Artificial Sequence
  Description of Artificial Sequence: Synthetic peptide
SAS

SEQ ID NO: 1424 - protein, 9 aa, Artificial Sequence
  Description of Artificial Sequence: Synthetic peptide
QQYSTYPLT

SEQ ID NO: 1425 - protein, 121 aa, Artificial Sequence
  Description of Artificial Sequence: Synthetic polypeptide
QVQLQQPGADLVKPGASVKLSCKASGYTSTSHWIHWVKQRPGQGLEWIGNIYPGSSSTNYNEKFKRMATLTVDTSSSTVYMVLSSLTSDDSAVYYCARHSPGHRDYAMDYWGLGTSVTVSS

SEQ ID NO: 1426 - protein, 107 aa, Artificial Sequence
  Description of Artificial Sequence: Synthetic polypeptide
DIVMTQSQKFMPTTVGDRVSITCKASQNVGTAVAWYQQKPGQSPKLLIASASNRYTGVPDRFTGSGSGTDFTLTISTMQSEDLADYFCQQYSTYPLTFGAGTKLEMK

SEQ ID NO: 1427 - protein, 451 aa, Artificial Sequence
  Description of Artificial Sequence: Synthetic polypeptide
QVQLQQPGADLVKPGASVKLSCKASGYTSTSHWIHWVKQRPGQGLEWIGNIYPGSSSTNYNEKFKRMATLTVDTSSSTVYMVLSSLTSDDSAVYYCARHSPGHRDYAMDYWGLGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1428 - protein, 214 aa, Artificial Sequence
  Description of Artificial Sequence: Synthetic polypeptide
DIVMTQSQKFMPTTVGDRVSITCKASQNVGTAVAWYQQKPGQSPKLLIASASNRYTGVPDRFTGSGSGTDFTLTISTMQSEDLADYFCQQYSTYPLTFGAGTKLEMKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1429 - protein, 7 aa, Artificial Sequence
  Description of Artificial Sequence: Synthetic peptide
TSGMGVS

SEQ ID NO: 1430 - protein, 16 aa, Artificial Sequence
  Description of Artificial Sequence: Synthetic peptide
HIFWDDDRRYKSSLKS

SEQ ID NO: 1431 - protein, 12 aa, Artificial Sequence
  Description of Artificial Sequence: Synthetic peptide
RVGYGDYAYFDV

SEQ ID NO: 1432 - protein, 11 aa, Artificial Sequence
  Description of Artificial Sequence: Synthetic peptide
RASENIYSDLA

SEQ ID NO: 1433 - protein, 7 aa, Artificial Sequence
  Description of Artificial Sequence: Synthetic peptide
AATNLAD

SEQ ID NO: 1434 - protein, 9 aa, Artificial Sequence
  Description of Artificial Sequence: Synthetic peptide
QHFWGTPWT

SEQ ID NO: 1435 - protein, 9 aa, Artificial Sequence
  Description of Artificial Sequence: Synthetic peptide
GFSLSTSGM

SEQ ID NO: 1436 - protein, 5 aa, Artificial Sequence
  Description of Artificial Sequence: Synthetic peptide
FWDDD

SEQ ID NO: 1437 - protein, 11 aa, Artificial Sequence
  Description of Artificial Sequence: Synthetic peptide
RVGYGDYAYFD

SEQ ID NO: 1438 - protein, 7 aa, Artificial Sequence
  Description of Artificial Sequence: Synthetic peptide
SENIYSD

SEQ ID NO: 1439 - protein, 3 aa, Artificial Sequence
  Description of Artificial Sequence: Synthetic peptide
AAT

SEQ ID NO: 1440 - protein, 6 aa, Artificial Sequence
  Description of Artificial Sequence: Synthetic peptide
FWGTPW

SEQ ID NO: 1441 - protein, 12 aa, Artificial Sequence
  Description of Artificial Sequence: Synthetic peptide
GFSLSTSGMGVS

SEQ ID NO: 1442 - protein, 9 aa, Artificial Sequence
  Description of Artificial Sequence: Synthetic peptide
HIFWDDDRR

SEQ ID NO: 1443 - protein, 12 aa, Artificial Sequence
  Description of Artificial Sequence: Synthetic peptide
RVGYGDYAYFDV

SEQ ID NO: 1444 - protein, 11 aa, Artificial Sequence
  Description of Artificial Sequence: Synthetic peptide
RASENIYSDLA

SEQ ID NO: 1445 - protein, 7 aa, Artificial Sequence
  Description of Artificial Sequence: Synthetic peptide
AATNLAD

SEQ ID NO: 1446 - protein, 9 aa, Artificial Sequence
  Description of Artificial Sequence: Synthetic peptide
QHFWGTPWT

SEQ ID NO: 1447 - protein, 8 aa, Artificial Sequence
  Description of Artificial Sequence: Synthetic peptide
STSGMGVS

SEQ ID NO: 1448 - protein, 12 aa, Artificial Sequence
  Description of Artificial Sequence: Synthetic peptide
WLAHIFWDDDRR

SEQ ID NO: 1449 - protein, 13 aa, Artificial Sequence
  Description of Artificial Sequence: Synthetic peptide
ARRVGYGDYAYFD

SEQ ID NO: 1450 - protein, 7 aa, Artificial Sequence
  Description of Artificial Sequence: Synthetic peptide
YSDLAWY

SEQ ID NO: 1451 - protein, 10 aa, Artificial Sequence
  Description of Artificial Sequence: Synthetic peptide
LLVYAATNLA

SEQ ID NO: 1452 - protein, 8 aa, Artificial Sequence
  Description of Artificial Sequence: Synthetic peptide
QHFWGTPW

SEQ ID NO: 1453 - protein, 10 aa, Artificial Sequence
  Description of Artificial Sequence: Synthetic peptide
GFSLSTSGMG

SEQ ID NO: 1454 - protein, 7 aa, Artificial Sequence
  Description of Artificial Sequence: Synthetic peptide
IFWDDDR

SEQ ID NO: 1455 - protein, 14 aa, Artificial Sequence
  Description of Artificial Sequence: Synthetic peptide
ARRVGYGDYAYFDV

SEQ ID NO: 1456 - protein, 6 aa, Artificial Sequence
  Description of Artificial Sequence: Synthetic peptide
ENIYSD

SEQ ID NO: 1457 - protein, 3 aa, Artificial Sequence
  Description of Artificial Sequence: Synthetic peptide
AAT

SEQ ID NO: 1458 - protein, 9 aa, Artificial Sequence
  Description of Artificial Sequence: Synthetic peptide
QHFWGTPWT

SEQ ID NO: 1459 - protein, 122 aa, Artificial Sequence
  Description of Artificial Sequence: Synthetic polypeptide
QVTLKESGPGKVQPSQTLSLTCSFSGFSLSTSGMGVSWIRKPSGKGLEWLAHIFWDDDRRYKSSLKSRLTISKDTSSNQVFLMITSVDTADSATYYCARRVGYGDYAYFDVWGAGTTVTVSS

SEQ ID NO: 1460 - protein, 107 aa, Artificial Sequence
  Description of Artificial Sequence: Synthetic polypeptide
DIQMTQYPASLSVSVGETVTITCRASENIYSDLAWYQQKQGKSPQLLVYAATNLADGVPSRFSGSGSGTQYSLKINSLQSEDFGNYYCQHFWGTPWTFGGGTKLEIK

SEQ ID NO: 1461 - protein, 452 aa, Artificial Sequence
  Description of Artificial Sequence: Synthetic polypeptide
QVTLKESGPGKVQPSQTLSLTCSFSGFSLSTSGMGVSWIRKPSGKGLEWLAHIFWDDDRRYKSSLKSRLTISKDTSSNQVFLMITSVDTADSATYYCARRVGYGDYAYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1462 - protein, 214 aa, Artificial Sequence
  Description of Artificial Sequence: Synthetic polypeptide
DIQMTQYPASLSVSVGETVTITCRASENIYSDLAWYQQKQGKSPQLLVYAATNLADGVPSRFSGSGSGTQYSLKINSLQSEDFGNYYCQHFWGTPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1463 - protein, 5 aa, Artificial Sequence
  Description of Artificial Sequence: Synthetic peptide
NYWIN

SEQ ID NO: 1464 - protein, 17 aa, Artificial Sequence
  Description of Artificial Sequence: Synthetic peptide
NIYPGSDSSNYNEKFKT

SEQ ID NO: 1465 - protein, 12 aa, Artificial Sequence
  Description of Artificial Sequence: Synthetic peptide
EEADYRYTWFVY

SEQ ID NO: 1466 - protein, 11 aa, Artificial Sequence
  Description of Artificial Sequence: Synthetic peptide
KASQNVGTAVA

SEQ ID NO: 1467 - protein, 7 aa, Artificial Sequence
  Description of Artificial Sequence: Synthetic peptide
SASNRYT

SEQ ID NO: 1468 - protein, 9 aa, Artificial Sequence
  Description of Artificial Sequence: Synthetic peptide
QQYSSYPLT

SEQ ID NO: 1469 - protein, 7 aa, Artificial Sequence
  Description of Artificial Sequence: Synthetic peptide
GYSFTNY

SEQ ID NO: 1470 - protein, 6 aa, Artificial Sequence
  Description of Artificial Sequence: Synthetic peptide
YPGSDS

SEQ ID NO: 1471 - protein, 11 aa, Artificial Sequence
  Description of Artificial Sequence: Synthetic peptide
EEADYRYTWFV

SEQ ID NO: 1472 - protein, 7 aa, Artificial Sequence
  Description of Artificial Sequence: Synthetic peptide
SQNVGTA

SEQ ID NO: 1473 - protein, 3 aa, Artificial Sequence
  Description of Artificial Sequence: Synthetic peptide
SAS

SEQ ID NO: 1474 - protein, 6 aa, Artificial Sequence
  Description of Artificial Sequence: Synthetic peptide
YSSYPL

SEQ ID NO: 1475 - protein, 10 aa, Artificial Sequence
  Description of Artificial Sequence: Synthetic peptide
GYSFTNYWIN

SEQ ID NO: 1476 - protein, 10 aa, Artificial Sequence
  Description of Artificial Sequence: Synthetic peptide
NIYPGSDSSN

SEQ ID NO: 1477 - protein, 12 aa, Artificial Sequence
  Description of Artificial Sequence: Synthetic peptide
EEADYRYTWFVY

SEQ ID NO: 1478 - protein, 11 aa, Artificial Sequence
  Description of Artificial Sequence: Synthetic peptide
KASQNVGTAVA

SEQ ID NO: 1479 - protein, 7 aa, Artificial Sequence
  Description of Artificial Sequence: Synthetic peptide
SASNRYT

SEQ ID NO: 1480 - protein, 9 aa, Artificial Sequence
  Description of Artificial Sequence: Synthetic peptide
QQYSSYPLT

SEQ ID NO: 1481 - protein, 6 aa, Artificial Sequence
  Description of Artificial Sequence: Synthetic peptide
TNYWIN

SEQ ID NO: 1482 - protein, 13 aa, Artificial Sequence
  Description of Artificial Sequence: Synthetic peptide
WIGNIYPGSDSSN

SEQ ID NO: 1483 - protein, 13 aa, Artificial Sequence
  Description of Artificial Sequence: Synthetic peptide
AREEADYRYTWFV

SEQ ID NO: 1484 - protein, 7 aa, Artificial Sequence
  Description of Artificial Sequence: Synthetic peptide
GTAVAWY

SEQ ID NO: 1485 - protein, 10 aa, Artificial Sequence
  Description of Artificial Sequence: Synthetic peptide
LLIYSASNRY

SEQ ID NO: 1486 - protein, 8 aa, Artificial Sequence
  Description of Artificial Sequence: Synthetic peptide
QQYSSYPL

SEQ ID NO: 1487 - protein, 8 aa, Artificial Sequence
  Description of Artificial Sequence: Synthetic peptide
GYSFTNYW

SEQ ID NO: 1488 - protein, 8 aa, Artificial Sequence
  Description of Artificial Sequence: Synthetic peptide
IYPGSDSS

SEQ ID NO: 1489 - protein, 14 aa, Artificial Sequence
  Description of Artificial Sequence: Synthetic peptide
AREEADYRYTWFVY

SEQ ID NO: 1490 - protein, 6 aa, Artificial Sequence
  Description of Artificial Sequence: Synthetic peptide
QNVGTA

SEQ ID NO: 1491 - protein, 3 aa, Artificial Sequence
  Description of Artificial Sequence: Synthetic peptide
SAS

SEQ ID NO: 1492 - protein, 9 aa, Artificial Sequence
  Description of Artificial Sequence: Synthetic peptide
QQYSSYPLT

SEQ ID NO: 1493 - protein, 121 aa, Artificial Sequence
  Description of Artificial Sequence: Synthetic polypeptide
QVQLQQSGAELVKPGASVKLSCKASGYSFTNYWINWMKQRPGQGLEWIGNIYPGSDSSNYNEKFKTKATLTVDTSSSTAYMQLSSLTSDDSAVYYCAREEADYRYTWFVYWGQGTLVTVSA

SEQ ID NO: 1494 - protein, 107 aa, Artificial Sequence
  Description of Artificial Sequence: Synthetic polypeptide
DIKMTQSQKFMSTTVGDRVSITCKASQNVGTAVAWYQQKPGQSPKLLIYSASNRYTGVPDRFTGSGSGTDFTLTFSNMQSEDLADYFCQQYSSYPLTFGAGTKLEMK

SEQ ID NO: 1495 - protein, 451 aa, Artificial Sequence
  Description of Artificial Sequence: Synthetic polypeptide
QVQLQQSGAELVKPGASVKLSCKASGYSFTNYWINWMKQRPGQGLEWIGNIYPGSDSSNYNEKFKTKATLTVDTSSSTAYMQLSSLTSDDSAVYYCAREEADYRYTWFVYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1496 - protein, 214 aa, Artificial Sequence
  Description of Artificial Sequence: Synthetic polypeptide
DIKMTQSQKFMSTTVGDRVSITCKASQNVGTAVAWYQQKPGQSPKLLIYSASNRYTGVPDRFTGSGSGTDFTLTFSNMQSEDLADYFCQQYSSYPLTFGAGTKLEMKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1497 - protein, 5 aa, Artificial Sequence
  Description of Artificial Sequence: Synthetic peptide
SYWIN

SEQ ID NO: 1498 - protein, 17 aa, Artificial Sequence
  Description of Artificial Sequence: Synthetic peptide
NIYPGSSSTNYNEKFKN

SEQ ID NO: 1499 - protein, 12 aa, Artificial Sequence
  Description of Artificial Sequence: Synthetic peptide
EEYSYKSSWFAY

SEQ ID NO: 1500 - protein, 11 aa, Artificial Sequence
  Description of Artificial Sequence: Synthetic peptide
KASQNVGTAVA

SEQ ID NO: 1501 - protein, 7 aa, Artificial Sequence
  Description of Artificial Sequence: Synthetic peptide
SASNRYN

SEQ ID NO: 1502 - protein, 9 aa, Artificial Sequence
  Description of Artificial Sequence: Synthetic peptide
QQYSTYPYT

SEQ ID NO: 1503 - protein, 7 aa, Artificial Sequence
  Description of Artificial Sequence: Synthetic peptide
GYSFTSY

SEQ ID NO: 1504 - protein, 6 aa, Artificial Sequence
  Description of Artificial Sequence: Synthetic peptide
YPGSSS

SEQ ID NO: 1505 - protein, 11 aa, Artificial Sequence
  Description of Artificial Sequence: Synthetic peptide
EEYSYKSSWFA

SEQ ID NO: 1506 - protein, 7 aa, Artificial Sequence
  Description of Artificial Sequence: Synthetic peptide
SQNVGTA

SEQ ID NO: 1507 - protein, 3 aa, Artificial Sequence
  Description of Artificial Sequence: Synthetic peptide
SAS

SEQ ID NO: 1508 - protein, 6 aa, Artificial Sequence
  Description of Artificial Sequence: Synthetic peptide
YSTYPY

SEQ ID NO: 1509 - protein, 10 aa, Artificial Sequence
  Description of Artificial Sequence: Synthetic peptide
GYSFTSYWIN

SEQ ID NO: 1510 - protein, 10 aa, Artificial Sequence
  Description of Artificial Sequence: Synthetic peptide
NIYPGSSSTN

SEQ ID NO: 1511 - protein, 12 aa, Artificial Sequence
  Description of Artificial Sequence: Synthetic peptide
EEYSYKSSWFAY

SEQ ID NO: 1512 - protein, 11 aa, Artificial Sequence
  Description of Artificial Sequence: Synthetic peptide
KASQNVGTAVA

SEQ ID NO: 1513 - protein, 7 aa, Artificial Sequence
  Description of Artificial Sequence: Synthetic peptide
SASNRYN

SEQ ID NO: 1514 - protein, 9 aa, Artificial Sequence
  Description of Artificial Sequence: Synthetic peptide
QQYSTYPYT

SEQ ID NO: 1515 - protein, 6 aa, Artificial Sequence
  Description of Artificial Sequence: Synthetic peptide
TSYWIN

SEQ ID NO: 1516 - protein, 13 aa, Artificial Sequence
  Description of Artificial Sequence: Synthetic peptide
WIGNIYPGSSSTN

SEQ ID NO: 1517 - protein, 13 aa, Artificial Sequence
  Description of Artificial Sequence: Synthetic peptide
AREEYSYKSSWFA

SEQ ID NO: 1518 - protein, 7 aa, Artificial Sequence
  Description of Artificial Sequence: Synthetic peptide
GTAVAWY

SEQ ID NO: 1519 - protein, 10 aa, Artificial Sequence
  Description of Artificial Sequence: Synthetic peptide
LLIYSASNRY

SEQ ID NO: 1520 - protein, 8 aa, Artificial Sequence
  Description of Artificial Sequence: Synthetic peptide
QQYSTYPY

SEQ ID NO: 1521 - protein, 8 aa, Artificial Sequence
  Description of Artificial Sequence: Synthetic peptide
GYSFTSYW

SEQ ID NO: 1522 - protein, 8 aa, Artificial Sequence
  Description of Artificial Sequence: Synthetic peptide
IYPGSSST

SEQ ID NO: 1523 - protein, 14 aa, Artificial Sequence
  Description of Artificial Sequence: Synthetic peptide
AREEYSYKSSWFAY

SEQ ID NO: 1524 - protein, 6 aa, Artificial Sequence
  Description of Artificial Sequence: Synthetic peptide
QNVGTA

SEQ ID NO: 1525 - protein, 3 aa, Artificial Sequence
  Description of Artificial Sequence: Synthetic peptide
SAS

SEQ ID NO: 1526 - protein, 9 aa, Artificial Sequence
  Description of Artificial Sequence: Synthetic peptide
QQYSTYPYT

SEQ ID NO: 1527 - protein, 121 aa, Artificial Sequence
  Description of Artificial Sequence: Synthetic polypeptide
EVQLQQSGTELVKPGASVKLSCKASGYSFTSYWINWVKQRPGQGPEWIGNIYPGSSSTNYNEKFKNKATLTVDTSSSTAYMQLSSLTSDDSAVYYCAREEYSYKSSWFAYWGQGTLVTVSA

SEQ ID NO: 1528 - protein, 107 aa, Artificial Sequence
  Description of Artificial Sequence: Synthetic polypeptide
DIVMTQSQKFMSTTVGDRVSITCKASQNVGTAVAWYQQKPGQSPKLLIYSASNRYNGVPDRFTGSGSGTDFTLTISNMQSEDLADYFCQQYSTYPYTFGSGTKLEIK

SEQ ID NO: 1529 - protein, 451 aa, Artificial Sequence
  Description of Artificial Sequence: Synthetic polypeptide
EVQLQQSGTELVKPGASVKLSCKASGYSFTSYWINWVKQRPGQGPEWIGNIYPGSSSTNYNEKFKNKATLTVDTSSSTAYMQLSSLTSDDSAVYYCAREEYSYKSSWFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1530 - protein, 214 aa, Artificial Sequence
  Description of Artificial Sequence: Synthetic polypeptide
DIVMTQSQKFMSTTVGDRVSITCKASQNVGTAVAWYQQKPGQSPKLLIYSASNRYNGVPDRFTGSGSGTDFTLTISNMQSEDLADYFCQQYSTYPYTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1531 - protein, 5 aa, Artificial Sequence
  Description of Artificial Sequence: Synthetic peptide
SYWIS

SEQ ID NO: 1532 - protein, 17 aa, Artificial Sequence
  Description of Artificial Sequence: Synthetic peptide
NIYPGSSSSNYNENFKS

SEQ ID NO: 1533 - protein, 12 aa, Artificial Sequence
  Description of Artificial Sequence: Synthetic peptide
EEYSYFPSWFAY

SEQ ID NO: 1534 - protein, 11 aa, Artificial Sequence
  Description of Artificial Sequence: Synthetic peptide
KASQNVGTAVA

SEQ ID NO: 1535 - protein, 7 aa, Artificial Sequence
  Description of Artificial Sequence: Synthetic peptide
SASNRYT

SEQ ID NO: 1536 - protein, 9 aa, Artificial Sequence
  Description of Artificial Sequence: Synthetic peptide
QQYSTYPFT

SEQ ID NO: 1537 - protein, 7 aa, Artificial Sequence
  Description of Artificial Sequence: Synthetic peptide
GYTFTSY

SEQ ID NO: 1538 - protein, 6 aa, Artificial Sequence
  Description of Artificial Sequence: Synthetic peptide
YPGSSS

SEQ ID NO: 1539 - protein, 11 aa, Artificial Sequence
  Description of Artificial Sequence: Synthetic peptide
EEYSYFPSWFA

SEQ ID NO: 1540 - protein, 7 aa, Artificial Sequence
  Description of Artificial Sequence: Synthetic peptide
SQNVGTA

SEQ ID NO: 1541 - protein, 3 aa, Artificial Sequence
  Description of Artificial Sequence: Synthetic peptide
SAS

SEQ ID NO: 1542 - protein, 6 aa, Artificial Sequence
  Description of Artificial Sequence: Synthetic peptide
YSTYPF

SEQ ID NO: 1543 - protein, 10 aa, Artificial Sequence
  Description of Artificial Sequence: Synthetic peptide
GYTFTSYWIS

SEQ ID NO: 1544 - protein, 10 aa, Artificial Sequence
  Description of Artificial Sequence: Synthetic peptide
NIYPGSSSSN

SEQ ID NO: 1545 - protein, 12 aa, Artificial Sequence
  Description of Artificial Sequence: Synthetic peptide
EEYSYFPSWFAY

SEQ ID NO: 1546 - protein, 11 aa, Artificial Sequence
  Description of Artificial Sequence: Synthetic peptide
KASQNVGTAVA

SEQ ID NO: 1547 - protein, 7 aa, Artificial Sequence
  Description of Artificial Sequence: Synthetic peptide
SASNRYT

SEQ ID NO: 1548 - protein, 9 aa, Artificial Sequence
  Description of Artificial Sequence: Synthetic peptide
QQYSTYPFT

SEQ ID NO: 1549 - protein, 6 aa, Artificial Sequence
  Description of Artificial Sequence: Synthetic peptide
TSYWIS

SEQ ID NO: 1550 - protein, 13 aa, Artificial Sequence
  Description of Artificial Sequence: Synthetic peptide
WIGNIYPGSSSSN

SEQ ID NO: 1551 - protein, 13 aa, Artificial Sequence
  Description of Artificial Sequence: Synthetic peptide
AREEYSYFPSWFA

SEQ ID NO: 1552 - protein, 7 aa, Artificial Sequence
  Description of Artificial Sequence: Synthetic peptide
GTAVAWF

SEQ ID NO: 1553 - protein, 10 aa, Artificial Sequence
  Description of Artificial Sequence: Synthetic peptide
LLIYSASNRY

SEQ ID NO: 1554 - protein, 8 aa, Artificial Sequence
  Description of Artificial Sequence: Synthetic peptide
QQYSTYPF

SEQ ID NO: 1555 - protein, 8 aa, Artificial Sequence
  Description of Artificial Sequence: Synthetic peptide
GYTFTSYW

SEQ ID NO: 1556 - protein, 8 aa, Artificial Sequence
  Description of Artificial Sequence: Synthetic peptide
IYPGSSSS

SEQ ID NO: 1557 - protein, 14 aa, Artificial Sequence
  Description of Artificial Sequence: Synthetic peptide
AREEYSYFPSWFAY

SEQ ID NO: 1558 - protein, 6 aa, Artificial Sequence
  Description of Artificial Sequence: Synthetic peptide
QNVGTA

SEQ ID NO: 1559 - protein, 3 aa, Artificial Sequence
  Description of Artificial Sequence: Synthetic peptide
SAS

SEQ ID NO: 1560 - protein, 9 aa, Artificial Sequence
  Description of Artificial Sequence: Synthetic peptide
QQYSTYPFT

SEQ ID NO: 1561 - protein, 121 aa, Artificial Sequence
  Description of Artificial Sequence: Synthetic polypeptide
EVQLQQSGAELVKPGASVKLSCKASGYTFTSYWISWVKQRPGQGLEWIGNIYPGSSSSNYNENFKSKATLTVDTSSSTAHMQLSSLTSDDSAVFYCAREEYSYFPSWFAYWGQGTSVTVSS

SEQ ID NO: 1562 - protein, 107 aa, Artificial Sequence
  Description of Artificial Sequence: Synthetic polypeptide
DIVMTQSQKFMSTTIGDRVSITCKASQNVGTAVAWFQQKPGQSPKLLIYSASNRYTGVPDRFTGSGSGTDFTLTISNMQSEDLANYFCQQYSTYPFTFGGGTKLEIK

SEQ ID NO: 1563 - protein, 451 aa, Artificial Sequence
  Description of Artificial Sequence: Synthetic polypeptide
EVQLQQSGAELVKPGASVKLSCKASGYTFTSYWISWVKQRPGQGLEWIGNIYPGSSSSNYNENFKSKATLTVDTSSSTAHMQLSSLTSDDSAVFYCAREEYSYFPSWFAYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1564 - protein, 214 aa, Artificial Sequence
  Description of Artificial Sequence: Synthetic polypeptide
DIVMTQSQKFMSTTIGDRVSITCKASQNVGTAVAWFQQKPGQSPKLLIYSASNRYTGVPDRFTGSGSGTDFTLTISNMQSEDLANYFCQQYSTYPFTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1565 - protein, 5 aa, Artificial Sequence
  Description of Artificial Sequence: Synthetic peptide
SFWIN

SEQ ID NO: 1566 - protein, 17 aa, Artificial Sequence
  Description of Artificial Sequence: Synthetic peptide
NIYPGSSSTNYSEKFKN

SEQ ID NO: 1567 - protein, 12 aa, Artificial Sequence
  Description of Artificial Sequence: Synthetic peptide
EEYSYKSSWFAY

SEQ ID NO: 1568 - protein, 11 aa, Artificial Sequence
  Description of Artificial Sequence: Synthetic peptide
KASQNVGTAVA

SEQ ID NO: 1569 - protein, 7 aa, Artificial Sequence
  Description of Artificial Sequence: Synthetic peptide
SASNRYN

SEQ ID NO: 1570 - protein, 9 aa, Artificial Sequence
  Description of Artificial Sequence: Synthetic peptide
QQYSTYPYT

SEQ ID NO: 1571 - protein, 7 aa, Artificial Sequence
  Description of Artificial Sequence: Synthetic peptide
GYSFASF

SEQ ID NO: 1572 - protein, 6 aa, Artificial Sequence
  Description of Artificial Sequence: Synthetic peptide
YPGSSS

SEQ ID NO: 1573 - protein, 11 aa, Artificial Sequence
  Description of Artificial Sequence: Synthetic peptide
EEYSYKSSWFA

SEQ ID NO: 1574 - protein, 7 aa, Artificial Sequence
  Description of Artificial Sequence: Synthetic peptide
SQNVGTA

SEQ ID NO: 1575 - protein, 3 aa, Artificial Sequence
  Description of Artificial Sequence: Synthetic peptide
SAS

SEQ ID NO: 1576 - protein, 6 aa, Artificial Sequence
  Description of Artificial Sequence: Synthetic peptide
YSTYPY

SEQ ID NO: 1577 - protein, 10 aa, Artificial Sequence
  Description of Artificial Sequence: Synthetic peptide
GYSFASFWIN

SEQ ID NO: 1578 - protein, 10 aa, Artificial Sequence
  Description of Artificial Sequence: Synthetic peptide
NIYPGSSSTN

SEQ ID NO: 1579 - protein, 12 aa, Artificial Sequence
  Description of Artificial Sequence: Synthetic peptide
EEYSYKSSWFAY

SEQ ID NO: 1580 - protein, 11 aa, Artificial Sequence
  Description of Artificial Sequence: Synthetic peptide
KASQNVGTAVA

SEQ ID NO: 1581 - protein, 7 aa, Artificial Sequence
  Description of Artificial Sequence: Synthetic peptide
SASNRYN

SEQ ID NO: 1582 - protein, 9 aa, Artificial Sequence
  Description of Artificial Sequence: Synthetic peptide
QQYSTYPYT

SEQ ID NO: 1583 - protein, 6 aa, Artificial Sequence
  Description of Artificial Sequence: Synthetic peptide
ASFWIN

SEQ ID NO: 1584 - protein, 13 aa, Artificial Sequence
  Description of Artificial Sequence: Synthetic peptide
WIGNIYPGSSSTN

SEQ ID NO: 1585 - protein, 13 aa, Artificial Sequence
  Description of Artificial Sequence: Synthetic peptide
AREEYSYKSSWFA

SEQ ID NO: 1586 - protein, 7 aa, Artificial Sequence
  Description of Artificial Sequence: Synthetic peptide
GTAVAWY

SEQ ID NO: 1587 - protein, 10 aa, Artificial Sequence
  Description of Artificial Sequence: Synthetic peptide
LLIYSASNRY

SEQ ID NO: 1588 - protein, 8 aa, Artificial Sequence
  Description of Artificial Sequence: Synthetic peptide
QQYSTYPY

SEQ ID NO: 1589 - protein, 8 aa, Artificial Sequence
  Description of Artificial Sequence: Synthetic peptide
GYSFASFW

SEQ ID NO: 1590 - protein, 8 aa, Artificial Sequence
  Description of Artificial Sequence: Synthetic peptide
IYPGSSST

SEQ ID NO: 1591 - protein, 14 aa, Artificial Sequence
  Description of Artificial Sequence: Synthetic peptide
AREEYSYKSSWFAY

SEQ ID NO: 1592 - protein, 6 aa, Artificial Sequence
  Description of Artificial Sequence: Synthetic peptide
QNVGTA

SEQ ID NO: 1593 - protein, 3 aa, Artificial Sequence
  Description of Artificial Sequence: Synthetic peptide
SAS

SEQ ID NO: 1594 - protein, 9 aa, Artificial Sequence
  Description of Artificial Sequence: Synthetic peptide
QQYSTYPYT

SEQ ID NO: 1595 - protein, 121 aa, Artificial Sequence
  Description of Artificial Sequence: Synthetic polypeptide
QVQLQQPGTELVKPGASVKLSCKASGYSFASFWINWVKQRPGQGPEWIGNIYPGSSSTNYSEKFKNKATLTVDKSSSTAYMQLSSLTSDDSAVYYCAREEYSYKSSWFAYWGQGTTVTVSS

SEQ ID NO: 1596 - protein, 107 aa, Artificial Sequence
  Description of Artificial Sequence: Synthetic polypeptide
DIVMTQSQKFMSTTVGDRVSITCKASQNVGTAVAWYQQKPGQSPKLLIYSASNRYNGVPDRFTGSGSGTDFTLTISNMQSEDLADYFCQQYSTYPYTFGSGTKLELK

SEQ ID NO: 1597 - protein, 451 aa, Artificial Sequence
  Description of Artificial Sequence: Synthetic polypeptide
QVQLQQPGTELVKPGASVKLSCKASGYSFASFWINWVKQRPGQGPEWIGNIYPGSSSTNYSEKFKNKATLTVDKSSSTAYMQLSSLTSDDSAVYYCAREEYSYKSSWFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1598 - protein, 214 aa, Artificial Sequence
  Description of Artificial Sequence: Synthetic polypeptide
DIVMTQSQKFMSTTVGDRVSITCKASQNVGTAVAWYQQKPGQSPKLLIYSASNRYNGVPDRFTGSGSGTDFTLTISNMQSEDLADYFCQQYSTYPYTFGSGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1599 - protein, 5 aa, Artificial Sequence
  Description of Artificial Sequence: Synthetic peptide
DDYIH

SEQ ID NO: 1600 - protein, 17 aa, Artificial Sequence
  Description of Artificial Sequence: Synthetic peptide
RIDPANGNPRYAPKFQD

SEQ ID NO: 1601 - protein, 10 aa, Artificial Sequence
  Description of Artificial Sequence: Synthetic peptide
DDEGYYYFDV

SEQ ID NO: 1602 - protein, 11 aa, Artificial Sequence
  Description of Artificial Sequence: Synthetic peptide
RASKSISKYLA

SEQ ID NO: 1603 - protein, 7 aa, Artificial Sequence
  Description of Artificial Sequence: Synthetic peptide
SGSTLQS

SEQ ID NO: 1604 - protein, 9 aa, Artificial Sequence
  Description of Artificial Sequence: Synthetic peptide
QQHNEYPLT

SEQ ID NO: 1605 - protein, 7 aa, Artificial Sequence
  Description of Artificial Sequence: Synthetic peptide
GFNIKDD

SEQ ID NO: 1606 - protein, 6 aa, Artificial Sequence
  Description of Artificial Sequence: Synthetic peptide
DPANGN

SEQ ID NO: 1607 - protein, 9 aa, Artificial Sequence
  Description of Artificial Sequence: Synthetic peptide
DDEGYYYFD

SEQ ID NO: 1608 - protein, 7 aa, Artificial Sequence
  Description of Artificial Sequence: Synthetic peptide
SKSISKY

SEQ ID NO: 1609 - protein, 3 aa, Artificial Sequence
  Description of Artificial Sequence: Synthetic peptide
SGS

SEQ ID NO: 1610 - protein, 6 aa, Artificial Sequence
  Description of Artificial Sequence: Synthetic peptide
HNEYPL

SEQ ID NO: 1611 - protein, 10 aa, Artificial Sequence
  Description of Artificial Sequence: Synthetic peptide
GFNIKDDYIH

SEQ ID NO: 1612 - protein, 10 aa, Artificial Sequence
  Description of Artificial Sequence: Synthetic peptide
RIDPANGNPR

SEQ ID NO: 1613 - protein, 10 aa, Artificial Sequence
  Description of Artificial Sequence: Synthetic peptide
DDEGYYYFDV

SEQ ID NO: 1614 - protein, 11 aa, Artificial Sequence
  Description of Artificial Sequence: Synthetic peptide
RASKSISKYLA

SEQ ID NO: 1615 - protein, 7 aa, Artificial Sequence
  Description of Artificial Sequence: Synthetic peptide
SGSTLQS

SEQ ID NO: 1616 - protein, 9 aa, Artificial Sequence
  Description of Artificial Sequence: Synthetic peptide
QQHNEYPLT

SEQ ID NO: 1617 - protein, 6 aa, Artificial Sequence
  Description of Artificial Sequence: Synthetic peptide
KDDYIH

SEQ ID NO: 1618 - protein, 13 aa, Artificial Sequence
  Description of Artificial Sequence: Synthetic peptide
WIGRIDPANGNPR

SEQ ID NO: 1619 - protein, 11 aa, Artificial Sequence
  Description of Artificial Sequence: Synthetic peptide
ARDDEGYYYFD

SEQ ID NO: 1620 - protein, 7 aa, Artificial Sequence
  Description of Artificial Sequence: Synthetic peptide
SKYLAWY

SEQ ID NO: 1621 - protein, 10 aa, Artificial Sequence
  Description of Artificial Sequence: Synthetic peptide
VLIYSGSTLQ

SEQ ID NO: 1622 - protein, 8 aa, Artificial Sequence
  Description of Artificial Sequence: Synthetic peptide
QQHNEYPL

SEQ ID NO: 1623 - protein, 8 aa, Artificial Sequence
  Description of Artificial Sequence: Synthetic peptide
GFNIKDDY

SEQ ID NO: 1624 - protein, 8 aa, Artificial Sequence
  Description of Artificial Sequence: Synthetic peptide
IDPANGNP

SEQ ID NO: 1625 - protein, 12 aa, Artificial Sequence
  Description of Artificial Sequence: Synthetic peptide
ARDDEGYYYFDV

SEQ ID NO: 1626 - protein, 6 aa, Artificial Sequence
  Description of Artificial Sequence: Synthetic peptide
KSISKY

SEQ ID NO: 1627 - protein, 3 aa, Artificial Sequence
  Description of Artificial Sequence: Synthetic peptide
SGS

SEQ ID NO: 1628 - protein, 9 aa, Artificial Sequence
  Description of Artificial Sequence: Synthetic peptide
QQHNEYPLT

SEQ ID NO: 1629 - protein, 119 aa, Artificial Sequence
  Description of Artificial Sequence: Synthetic polypeptide
EVQLQQSGPELVRPGASVKLSCTASGFNIKDDYIHWVKQRPEQGLEWIGRIDPANGNPRYAPKFQDKATLTADTSSNTAYLQLSSLTSEDTAVYYCARDDEGYYYFDVWGAGTSVTVSS

SEQ ID NO: 1630 - protein, 107 aa, Artificial Sequence
  Description of Artificial Sequence: Synthetic polypeptide
DIKMTQSPSYLAASPGETITINCRASKSISKYLAWYQEKPGKTNKVLIYSGSTLQSGIPSRFSGSGSGTDFTLTISSLEPEDFAIYYCQQHNEYPLTFGDGTRLEIK

SEQ ID NO: 1631 - protein, 449 aa, Artificial Sequence
  Description of Artificial Sequence: Synthetic polypeptide
EVQLQQSGPELVRPGASVKLSCTASGFNIKDDYIHWVKQRPEQGLEWIGRIDPANGNPRYAPKFQDKATLTADTSSNTAYLQLSSLTSEDTAVYYCARDDEGYYYFDVWGAGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1632 - protein, 214 aa, Artificial Sequence
  Description of Artificial Sequence: Synthetic polypeptide
DIKMTQSPSYLAASPGETITINCRASKSISKYLAWYQEKPGKTNKVLIYSGSTLQSGIPSRFSGSGSGTDFTLTISSLEPEDFAIYYCQQHNEYPLTFGDGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1633 - protein, 5 aa, Artificial Sequence
  Description of Artificial Sequence: Synthetic peptide
SYWIN

SEQ ID NO: 1634 - protein, 17 aa, Artificial Sequence
  Description of Artificial Sequence: Synthetic peptide
NIYPFSSSTNYNEKFKK

SEQ ID NO: 1635 - protein, 12 aa, Artificial Sequence
  Description of Artificial Sequence: Synthetic peptide
EEFSHYPSWFAY

SEQ ID NO: 1636 - protein, 11 aa, Artificial Sequence
  Description of Artificial Sequence: Synthetic peptide
KASQNVGIAVA

SEQ ID NO: 1637 - protein, 7 aa, Artificial Sequence
  Description of Artificial Sequence: Synthetic peptide
SASNRYT

SEQ ID NO: 1638 - protein, 9 aa, Artificial Sequence
  Description of Artificial Sequence: Synthetic peptide
QQYSTDPYT

SEQ ID NO: 1639 - protein, 7 aa, Artificial Sequence
  Description of Artificial Sequence: Synthetic peptide
GYTFTSY

SEQ ID NO: 1640 - protein, 6 aa, Artificial Sequence
  Description of Artificial Sequence: Synthetic peptide
YPFSSS

SEQ ID NO: 1641 - protein, 11 aa, Artificial Sequence
  Description of Artificial Sequence: Synthetic peptide
EEFSHYPSWFA

SEQ ID NO: 1642 - protein, 7 aa, Artificial Sequence
  Description of Artificial Sequence: Synthetic peptide
SQNVGIA

SEQ ID NO: 1643 - protein, 3 aa, Artificial Sequence
  Description of Artificial Sequence: Synthetic peptide
SAS

SEQ ID NO: 1644 - protein, 6 aa, Artificial Sequence
  Description of Artificial Sequence: Synthetic peptide
YSTDPY

SEQ ID NO: 1645 - protein, 10 aa, Artificial Sequence
  Description of Artificial Sequence: Synthetic peptide
GYTFTSYWIN

SEQ ID NO: 1646 - protein, 10 aa, Artificial Sequence
  Description of Artificial Sequence: Synthetic peptide
NIYPFSSSTN

SEQ ID NO: 1647 - protein, 12 aa, Artificial Sequence
  Description of Artificial Sequence: Synthetic peptide
EEFSHYPSWFAY

SEQ ID NO: 1648 - protein, 11 aa, Artificial Sequence
  Description of Artificial Sequence: Synthetic peptide
KASQNVGIAVA

SEQ ID NO: 1649 - protein, 7 aa, Artificial Sequence
  Description of Artificial Sequence: Synthetic peptide
SASNRYT

SEQ ID NO: 1650 - protein, 9 aa, Artificial Sequence
  Description of Artificial Sequence: Synthetic peptide
QQYSTDPYT

SEQ ID NO: 1651 - protein, 6 aa, Artificial Sequence
  Description of Artificial Sequence: Synthetic peptide
TSYWIN

SEQ ID NO: 1652 - protein, 13 aa, Artificial Sequence
  Description of Artificial Sequence: Synthetic peptide
WIGNIYPFSSSTN

SEQ ID NO: 1653 - protein, 13 aa, Artificial Sequence
  Description of Artificial Sequence: Synthetic peptide
AREEFSHYPSWFA

SEQ ID NO: 1654 - protein, 7 aa, Artificial Sequence
  Description of Artificial Sequence: Synthetic peptide
GIAVAWF

SEQ ID NO: 1655 - protein, 10 aa, Artificial Sequence
  Description of Artificial Sequence: Synthetic peptide
LLIYSASNRY

SEQ ID NO: 1656 - protein, 8 aa, Artificial Sequence
  Description of Artificial Sequence: Synthetic peptide
QQYSTDPY

SEQ ID NO: 1657 - protein, 8 aa, Artificial Sequence
  Description of Artificial Sequence: Synthetic peptide
GYTFTSYW

SEQ ID NO: 1658 - protein, 8 aa, Artificial Sequence
  Description of Artificial Sequence: Synthetic peptide
IYPFSSST

SEQ ID NO: 1659 - protein, 14 aa, Artificial Sequence
  Description of Artificial Sequence: Synthetic peptide
AREEFSHYPSWFAY

SEQ ID NO: 1660 - protein, 6 aa, Artificial Sequence
  Description of Artificial Sequence: Synthetic peptide
QNVGIA

SEQ ID NO: 1661 - protein, 3 aa, Artificial Sequence
  Description of Artificial Sequence: Synthetic peptide
SAS

SEQ ID NO: 1662 - protein, 9 aa, Artificial Sequence
  Description of Artificial Sequence: Synthetic peptide
QQYSTDPYT

SEQ ID NO: 1663 - protein, 121 aa, Artificial Sequence
  Description of Artificial Sequence: Synthetic polypeptide
QVQLQQPGTELVKPGASVKLSCKASGYTFTSYWINWMKQRPGQGLEWIGNIYPFSSSTNYNEKFKKKATLTVDASSSTASMQLSSLTSDDSAVYFCAREEFSHYPSWFAYWGQGTTLTVSS

SEQ ID NO: 1664 - protein, 107 aa, Artificial Sequence
  Description of Artificial Sequence: Synthetic polypeptide
DIVMTQSQKFMSTTVGDRVSITCKASQNVGIAVAWFQQKPGQSPKLLIYSASNRYTGVPDRFTGSGSGTDFTLTIGNMQSEDLADYFCQQYSTDPYTFGSGTKLEIK

SEQ ID NO: 1665 - protein, 451 aa, Artificial Sequence
  Description of Artificial Sequence: Synthetic polypeptide
QVQLQQPGTELVKPGASVKLSCKASGYTFTSYWINWMKQRPGQGLEWIGNIYPFSSSTNYNEKFKKKATLTVDASSSTASMQLSSLTSDDSAVYFCAREEFSHYPSWFAYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1666 - protein, 214 aa, Artificial Sequence
  Description of Artificial Sequence: Synthetic polypeptide
DIVMTQSQKFMSTTVGDRVSITCKASQNVGIAVAWFQQKPGQSPKLLIYSASNRYTGVPDRFTGSGSGTDFTLTIGNMQSEDLADYFCQQYSTDPYTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1667 - protein, 5 aa, Artificial Sequence
  Description of Artificial Sequence: Synthetic peptide
SYWIN

SEQ ID NO: 1668 - protein, 17 aa, Artificial Sequence
  Description of Artificial Sequence: Synthetic peptide
NIYPGSSSTNYNEKFKN

SEQ ID NO: 1669 - protein, 13 aa, Artificial Sequence
  Description of Artificial Sequence: Synthetic peptide
ELGAYYHYSAMDY

SEQ ID NO: 1670 - protein, 11 aa, Artificial Sequence
  Description of Artificial Sequence: Synthetic peptide
KASQNVGTAVA

SEQ ID NO: 1671 - protein, 7 aa, Artificial Sequence
  Description of Artificial Sequence: Synthetic peptide
SASNRYT

SEQ ID NO: 1672 - protein, 9 aa, Artificial Sequence
  Description of Artificial Sequence: Synthetic peptide
QQYSIYPFT

SEQ ID NO: 1673 - protein, 7 aa, Artificial Sequence
  Description of Artificial Sequence: Synthetic peptide
GYTFTSY

SEQ ID NO: 1674 - protein, 6 aa, Artificial Sequence
  Description of Artificial Sequence: Synthetic peptide
YPGSSS

SEQ ID NO: 1675 - protein, 12 aa, Artificial Sequence
  Description of Artificial Sequence: Synthetic peptide
ELGAYYHYSAMD

SEQ ID NO: 1676 - protein, 7 aa, Artificial Sequence
  Description of Artificial Sequence: Synthetic peptide
SQNVGTA

SEQ ID NO: 1677 - protein, 3 aa, Artificial Sequence
  Description of Artificial Sequence: Synthetic peptide
SAS

SEQ ID NO: 1678 - protein, 6 aa, Artificial Sequence
  Description of Artificial Sequence: Synthetic peptide
YSIYPF

SEQ ID NO: 1679 - protein, 10 aa, Artificial Sequence
  Description of Artificial Sequence: Synthetic peptide
GYTFTSYWIN

SEQ ID NO: 1680 - protein, 10 aa, Artificial Sequence
  Description of Artificial Sequence: Synthetic peptide
NIYPGSSSTN

SEQ ID NO: 1681 - protein, 13 aa, Artificial Sequence
  Description of Artificial Sequence: Synthetic peptide
ELGAYYHYSAMDY

SEQ ID NO: 1682 - protein, 11 aa, Artificial Sequence
  Description of Artificial Sequence: Synthetic peptide
KASQNVGTAVA

SEQ ID NO: 1683 - protein, 7 aa, Artificial Sequence
  Description of Artificial Sequence: Synthetic peptide
SASNRYT

SEQ ID NO: 1684 - protein, 9 aa, Artificial Sequence
  Description of Artificial Sequence: Synthetic peptide
QQYSIYPFT

SEQ ID NO: 1685 - protein, 6 aa, Artificial Sequence
  Description of Artificial Sequence: Synthetic peptide
TSYWIN

SEQ ID NO: 1686 - protein, 13 aa, Artificial Sequence
  Description of Artificial Sequence: Synthetic peptide
WIGNIYPGSSSTN

SEQ ID NO: 1687 - protein, 14 aa, Artificial Sequence
  Description of Artificial Sequence: Synthetic peptide
TRELGAYYHYSAMD

SEQ ID NO: 1688 - protein, 7 aa, Artificial Sequence
  Description of Artificial Sequence: Synthetic peptide
GTAVAWY

SEQ ID NO: 1689 - protein, 10 aa, Artificial Sequence
  Description of Artificial Sequence: Synthetic peptide
LLIYSASNRY

SEQ ID NO: 1690 - protein, 8 aa, Artificial Sequence
  Description of Artificial Sequence: Synthetic peptide
QQYSIYPF

SEQ ID NO: 1691 - protein, 8 aa, Artificial Sequence
  Description of Artificial Sequence: Synthetic peptide
GYTFTSYW

SEQ ID NO: 1692 - protein, 8 aa, Artificial Sequence
  Description of Artificial Sequence: Synthetic peptide
IYPGSSST

SEQ ID NO: 1693 - protein, 15 aa, Artificial Sequence
  Description of Artificial Sequence: Synthetic peptide
TRELGAYYHYSAMDY

SEQ ID NO: 1694 - protein, 6 aa, Artificial Sequence
  Description of Artificial Sequence: Synthetic peptide
QNVGTA

SEQ ID NO: 1695 - protein, 3 aa, Artificial Sequence
  Description of Artificial Sequence: Synthetic peptide
SAS

SEQ ID NO: 1696 - protein, 9 aa, Artificial Sequence
  Description of Artificial Sequence: Synthetic peptide
QQYSIYPFT

SEQ ID NO: 1697 - protein, 122 aa, Artificial Sequence
  Description of Artificial Sequence: Synthetic polypeptide
EVQLQQSGAELVKPGASVKLSCKASGYTFTSYWINWVKQRPGQGLEWIGNIYPGSSSTNYNEKFKNKATLTVDTSSSTVYMQLSSLTSDDSAVYYCTRELGAYYHYSAMDYWGQGTSVTVSS

SEQ ID NO: 1698 - protein, 107 aa, Artificial Sequence
  Description of Artificial Sequence: Synthetic polypeptide
DIVLTQSQKIMSTTVGDRVSITCKASQNVGTAVAWYQQKPGQSPKLLIYSASNRYTGVPDRFTGSGSGTDFTLTISNMQSEDLADYFCQQYSIYPFTFGSGTKLEIK

SEQ ID NO: 1699 - protein, 452 aa, Artificial Sequence
  Description of Artificial Sequence: Synthetic polypeptide
EVQLQQSGAELVKPGASVKLSCKASGYTFTSYWINWVKQRPGQGLEWIGNIYPGSSSTNYNEKFKNKATLTVDTSSSTVYMQLSSLTSDDSAVYYCTRELGAYYHYSAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1700 - protein, 214 aa, Artificial Sequence
  Description of Artificial Sequence: Synthetic polypeptide
DIVLTQSQKIMSTTVGDRVSITCKASQNVGTAVAWYQQKPGQSPKLLIYSASNRYTGVPDRFTGSGSGTDFTLTISNMQSEDLADYFCQQYSIYPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1701 - protein, 5 aa, Artificial Sequence
  Description of Artificial Sequence: Synthetic peptide
SYWMH

SEQ ID NO: 1702 - protein, 17 aa, Artificial Sequence
  Description of Artificial Sequence: Synthetic peptide
NINPSSGYAVYNQKFKD

SEQ ID NO: 1703 - protein, 11 aa, Artificial Sequence
  Description of Artificial Sequence: Synthetic peptide
RVFYGDSWFAY

SEQ ID NO: 1704 - protein, 11 aa, Artificial Sequence
  Description of Artificial Sequence: Synthetic peptide
RASGNIHNYLA

SEQ ID NO: 1705 - protein, 7 aa, Artificial Sequence
  Description of Artificial Sequence: Synthetic peptide
NAKTLAD

SEQ ID NO: 1706 - protein, 9 aa, Artificial Sequence
  Description of Artificial Sequence: Synthetic peptide
QHFWSTTWT

SEQ ID NO: 1707 - protein, 7 aa, Artificial Sequence
  Description of Artificial Sequence: Synthetic peptide
GYIFTSY

SEQ ID NO: 1708 - protein, 6 aa, Artificial Sequence
  Description of Artificial Sequence: Synthetic peptide
NPSSGY

SEQ ID NO: 1709 - protein, 10 aa, Artificial Sequence
  Description of Artificial Sequence: Synthetic peptide
RVFYGDSWFA

SEQ ID NO: 1710 - protein, 7 aa, Artificial Sequence
  Description of Artificial Sequence: Synthetic peptide
SGNIHNY

SEQ ID NO: 1711 - protein, 3 aa, Artificial Sequence
  Description of Artificial Sequence: Synthetic peptide
NAK

SEQ ID NO: 1712 - protein, 6 aa, Artificial Sequence
  Description of Artificial Sequence: Synthetic peptide
FWSTTW

SEQ ID NO: 1713 - protein, 10 aa, Artificial Sequence
  Description of Artificial Sequence: Synthetic peptide
GYIFTSYWMH

SEQ ID NO: 1714 - protein, 10 aa, Artificial Sequence
  Description of Artificial Sequence: Synthetic peptide
NINPSSGYAV

SEQ ID NO: 1715 - protein, 11 aa, Artificial Sequence
  Description of Artificial Sequence: Synthetic peptide
RVFYGDSWFAY

SEQ ID NO: 1716 - protein, 11 aa, Artificial Sequence
  Description of Artificial Sequence: Synthetic peptide
RASGNIHNYLA

SEQ ID NO: 1717 - protein, 7 aa, Artificial Sequence
  Description of Artificial Sequence: Synthetic peptide
NAKTLAD

SEQ ID NO: 1718 - protein, 9 aa, Artificial Sequence
  Description of Artificial Sequence: Synthetic peptide
QHFWSTTWT

SEQ ID NO: 1719 - protein, 6 aa, Artificial Sequence
  Description of Artificial Sequence: Synthetic peptide
TSYWMH

SEQ ID NO: 1720 - protein, 13 aa, Artificial Sequence
  Description of Artificial Sequence: Synthetic peptide
WIGNINPSSGYAV

SEQ ID NO: 1721 - protein, 12 aa, Artificial Sequence
  Description of Artificial Sequence: Synthetic peptide
ARRVFYGDSWFA

SEQ ID NO: 1722 - protein, 7 aa, Artificial Sequence
  Description of Artificial Sequence: Synthetic peptide
HNYLAWY

SEQ ID NO: 1723 - protein, 10 aa, Artificial Sequence
  Description of Artificial Sequence: Synthetic peptide
LLVYNAKTLA

SEQ ID NO: 1724 - protein, 8 aa, Artificial Sequence
  Description of Artificial Sequence: Synthetic peptide
QHFWSTTW

SEQ ID NO: 1725 - protein, 8 aa, Artificial Sequence
  Description of Artificial Sequence: Synthetic peptide
GYIFTSYW

SEQ ID NO: 1726 - protein, 8 aa, Artificial Sequence
  Description of Artificial Sequence: Synthetic peptide
INPSSGYA

SEQ ID NO: 1727 - protein, 13 aa, Artificial Sequence
  Description of Artificial Sequence: Synthetic peptide
ARRVFYGDSWFAY

SEQ ID NO: 1728 - protein, 6 aa, Artificial Sequence
  Description of Artificial Sequence: Synthetic peptide
GNIHNY

SEQ ID NO: 1729 - protein, 3 aa, Artificial Sequence
  Description of Artificial Sequence: Synthetic peptide
NAK

SEQ ID NO: 1730 - protein, 9 aa, Artificial Sequence
  Description of Artificial Sequence: Synthetic peptide
QHFWSTTWT

SEQ ID NO: 1731 - protein, 120 aa, Artificial Sequence
  Description of Artificial Sequence: Synthetic polypeptide
QVQLQQSGAELAKPGASVKMSCKASGYIFTSYWMHWVKQRPGQGLEWIGNINPSSGYAVYNQKFKDKATLTADQSSSTAYIQLNSLTSEDSAVYYCARRVFYGDSWFAYWGQGTSVTVSS

SEQ ID NO: 1732 - protein, 107 aa, Artificial Sequence
  Description of Artificial Sequence: Synthetic polypeptide
DVQMIQSPASLSASVGETVTITCRASGNIHNYLAWYQQKQGKSPQLLVYNAKTLADGVPSRFSGSGSGTQYSLKINSLQPEDFGSYYCQHFWSTTWTFGGGTKLEIK

SEQ ID NO: 1733 - protein, 450 aa, Artificial Sequence
  Description of Artificial Sequence: Synthetic polypeptide
QVQLQQSGAELAKPGASVKMSCKASGYIFTSYWMHWVKQRPGQGLEWIGNINPSSGYAVYNQKFKDKATLTADQSSSTAYIQLNSLTSEDSAVYYCARRVFYGDSWFAYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1734 - protein, 214 aa, Artificial Sequence
  Description of Artificial Sequence: Synthetic polypeptide
DVQMIQSPASLSASVGETVTITCRASGNIHNYLAWYQQKQGKSPQLLVYNAKTLADGVPSRFSGSGSGTQYSLKINSLQPEDFGSYYCQHFWSTTWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1735 - protein, 5 aa, Artificial Sequence
  Description of Artificial Sequence: Synthetic peptide
SYYMH

SEQ ID NO: 1736 - protein, 17 aa, Artificial Sequence
  Description of Artificial Sequence: Synthetic peptide
YIDPFNGNTNYKQKFKG

SEQ ID NO: 1737 - protein, 12 aa, Artificial Sequence
  Description of Artificial Sequence: Synthetic peptide
PNSNYVGTWFAY

SEQ ID NO: 1738 - protein, 11 aa, Artificial Sequence
  Description of Artificial Sequence: Synthetic peptide
HASQNINVWLS

SEQ ID NO: 1739 - protein, 7 aa, Artificial Sequence
  Description of Artificial Sequence: Synthetic peptide
KASNLHT

SEQ ID NO: 1740 - protein, 9 aa, Artificial Sequence
  Description of Artificial Sequence: Synthetic peptide
QQGQSFPFT

SEQ ID NO: 1741 - protein, 7 aa, Artificial Sequence
  Description of Artificial Sequence: Synthetic peptide
GYSFTSY

SEQ ID NO: 1742 - protein, 6 aa, Artificial Sequence
  Description of Artificial Sequence: Synthetic peptide
DPFNGN

SEQ ID NO: 1743 - protein, 11 aa, Artificial Sequence
  Description of Artificial Sequence: Synthetic peptide
PNSNYVGTWFA

SEQ ID NO: 1744 - protein, 7 aa, Artificial Sequence
  Description of Artificial Sequence: Synthetic peptide
SQNINVW

SEQ ID NO: 1745 - protein, 3 aa, Artificial Sequence
  Description of Artificial Sequence: Synthetic peptide
KAS

SEQ ID NO: 1746 - protein, 6 aa, Artificial Sequence
  Description of Artificial Sequence: Synthetic peptide
GQSFPF

SEQ ID NO: 1747 - protein, 10 aa, Artificial Sequence
  Description of Artificial Sequence: Synthetic peptide
GYSFTSYYMH

SEQ ID NO: 1748 - protein, 10 aa, Artificial Sequence
  Description of Artificial Sequence: Synthetic peptide
YIDPFNGNTN

SEQ ID NO: 1749 - protein, 12 aa, Artificial Sequence
  Description of Artificial Sequence: Synthetic peptide
PNSNYVGTWFAY

SEQ ID NO: 1750 - protein, 11 aa, Artificial Sequence
  Description of Artificial Sequence: Synthetic peptide
HASQNINVWLS

SEQ ID NO: 1751 - protein, 7 aa, Artificial Sequence
  Description of Artificial Sequence: Synthetic peptide
KASNLHT

SEQ ID NO: 1752 - protein, 9 aa, Artificial Sequence
  Description of Artificial Sequence: Synthetic peptide
QQGQSFPFT

SEQ ID NO: 1753 - protein, 6 aa, Artificial Sequence
  Description of Artificial Sequence: Synthetic peptide
TSYYMH

SEQ ID NO: 1754 - protein, 13 aa, Artificial Sequence
  Description of Artificial Sequence: Synthetic peptide
WIGYIDPFNGNTN

SEQ ID NO: 1755 - protein, 13 aa, Artificial Sequence
  Description of Artificial Sequence: Synthetic peptide
ASPNSNYVGTWFA

SEQ ID NO: 1756 - protein, 7 aa, Artificial Sequence
  Description of Artificial Sequence: Synthetic peptide
NVWLSWY

SEQ ID NO: 1757 - protein, 10 aa, Artificial Sequence
  Description of Artificial Sequence: Synthetic peptide
LLIYKASNLH

SEQ ID NO: 1758 - protein, 8 aa, Artificial Sequence
  Description of Artificial Sequence: Synthetic peptide
QQGQSFPF

SEQ ID NO: 1759 - protein, 8 aa, Artificial Sequence
  Description of Artificial Sequence: Synthetic peptide
GYSFTSYY

SEQ ID NO: 1760 - protein, 8 aa, Artificial Sequence
  Description of Artificial Sequence: Synthetic peptide
IDPFNGNT

SEQ ID NO: 1761 - protein, 14 aa, Artificial Sequence
  Description of Artificial Sequence: Synthetic peptide
ASPNSNYVGTWFAY

SEQ ID NO: 1762 - protein, 6 aa, Artificial Sequence
  Description of Artificial Sequence: Synthetic peptide
QNINVW

SEQ ID NO: 1763 - protein, 3 aa, Artificial Sequence
  Description of Artificial Sequence: Synthetic peptide
KAS

SEQ ID NO: 1764 - protein, 9 aa, Artificial Sequence
  Description of Artificial Sequence: Synthetic peptide
QQGQSFPFT

SEQ ID NO: 1765 - protein, 121 aa, Artificial Sequence
  Description of Artificial Sequence: Synthetic polypeptide
EFQLQQSGPELMKPGASVKISCKASGYSFTSYYMHWMKQSHGKSLEWIGYIDPFNGNTNYKQKFKGKATLTVDKSSSTAYMHLSSLTSEDSAVYYCASPNSNYVGTWFAYWGQGTTVTVSS

SEQ ID NO: 1766 - protein, 107 aa, Artificial Sequence
  Description of Artificial Sequence: Synthetic polypeptide
NTQMNQTPSSLSASLGDTVTITCHASQNINVWLSWYQQKPGNIPKLLIYKASNLHTGVPSRFSGSGSGTGFTLTISSLQPDDIATYYCQQGQSFPFTFGSGTKLEIK

SEQ ID NO: 1767 - protein, 451 aa, Artificial Sequence
  Description of Artificial Sequence: Synthetic polypeptide
EFQLQQSGPELMKPGASVKISCKASGYSFTSYYMHWMKQSHGKSLEWIGYIDPFNGNTNYKQKFKGKATLTVDKSSSTAYMHLSSLTSEDSAVYYCASPNSNYVGTWFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1768 - protein, 214 aa, Artificial Sequence
  Description of Artificial Sequence: Synthetic polypeptide
NTQMNQTPSSLSASLGDTVTITCHASQNINVWLSWYQQKPGNIPKLLIYKASNLHTGVPSRFSGSGSGTGFTLTISSLQPDDIATYYCQQGQSFPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1769 - protein, 5 aa, Artificial Sequence
  Description of Artificial Sequence: Synthetic peptide
DYYMN

SEQ ID NO: 1770 - protein, 17 aa, Artificial Sequence
  Description of Artificial Sequence: Synthetic peptide
VINPYNGGTTYNQRFTG

SEQ ID NO: 1771 - protein, 7 aa, Artificial Sequence
  Description of Artificial Sequence: Synthetic peptide
NYGAMDS

SEQ ID NO: 1772 - protein, 11 aa, Artificial Sequence
  Description of Artificial Sequence: Synthetic peptide
RASGNIHNYLA

SEQ ID NO: 1773 - protein, 7 aa, Artificial Sequence
  Description of Artificial Sequence: Synthetic peptide
NAKTLAD

SEQ ID NO: 1774 - protein, 9 aa, Artificial Sequence
  Description of Artificial Sequence: Synthetic peptide
QHFWITPPT

SEQ ID NO: 1775 - protein, 7 aa, Artificial Sequence
  Description of Artificial Sequence: Synthetic peptide
GYTFTDY

SEQ ID NO: 1776 - protein, 6 aa, Artificial Sequence
  Description of Artificial Sequence: Synthetic peptide
NPYNGG

SEQ ID NO: 1777 - protein, 6 aa, Artificial Sequence
  Description of Artificial Sequence: Synthetic peptide
NYGAMD

SEQ ID NO: 1778 - protein, 7 aa, Artificial Sequence
  Description of Artificial Sequence: Synthetic peptide
SGNIHNY

SEQ ID NO: 1779 - protein, 3 aa, Artificial Sequence
  Description of Artificial Sequence: Synthetic peptide
NAK

SEQ ID NO: 1780 - protein, 6 aa, Artificial Sequence
  Description of Artificial Sequence: Synthetic peptide
FWITPP

SEQ ID NO: 1781 - protein, 10 aa, Artificial Sequence
  Description of Artificial Sequence: Synthetic peptide
GYTFTDYYMN

SEQ ID NO: 1782 - protein, 10 aa, Artificial Sequence
  Description of Artificial Sequence: Synthetic peptide
VINPYNGGTT

SEQ ID NO: 1783 - protein, 7 aa, Artificial Sequence
  Description of Artificial Sequence: Synthetic peptide
NYGAMDS

SEQ ID NO: 1784 - protein, 11 aa, Artificial Sequence
  Description of Artificial Sequence: Synthetic peptide
RASGNIHNYLA

SEQ ID NO: 1785 - protein, 7 aa, Artificial Sequence
  Description of Artificial Sequence: Synthetic peptide
NAKTLAD

SEQ ID NO: 1786 - protein, 9 aa, Artificial Sequence
  Description of Artificial Sequence: Synthetic peptide
QHFWITPPT

SEQ ID NO: 1787 - protein, 6 aa, Artificial Sequence
  Description of Artificial Sequence: Synthetic peptide
TDYYMN

SEQ ID NO: 1788 - protein, 13 aa, Artificial Sequence
  Description of Artificial Sequence: Synthetic peptide
WIGVINPYNGGTT

SEQ ID NO: 1789 - protein, 8 aa, Artificial Sequence
  Description of Artificial Sequence: Synthetic peptide
ARNYGAMD

SEQ ID NO: 1790 - protein, 7 aa, Artificial Sequence
  Description of Artificial Sequence: Synthetic peptide
HNYLAWY

SEQ ID NO: 1791 - protein, 10 aa, Artificial Sequence
  Description of Artificial Sequence: Synthetic peptide
LLVSNAKTLA

SEQ ID NO: 1792 - protein, 8 aa, Artificial Sequence
  Description of Artificial Sequence: Synthetic peptide
QHFWITPP

SEQ ID NO: 1793 - protein, 8 aa, Artificial Sequence
  Description of Artificial Sequence: Synthetic peptide
GYTFTDYY

SEQ ID NO: 1794 - protein, 8 aa, Artificial Sequence
  Description of Artificial Sequence: Synthetic peptide
INPYNGGT

SEQ ID NO: 1795 - protein, 9 aa, Artificial Sequence
  Description of Artificial Sequence: Synthetic peptide
ARNYGAMDS

SEQ ID NO: 1796 - protein, 6 aa, Artificial Sequence
  Description of Artificial Sequence: Synthetic peptide
GNIHNY

SEQ ID NO: 1797 - protein, 3 aa, Artificial Sequence
  Description of Artificial Sequence: Synthetic peptide
NAK

SEQ ID NO: 1798 - protein, 9 aa, Artificial Sequence
  Description of Artificial Sequence: Synthetic peptide
QHFWITPPT

SEQ ID NO: 1799 - protein, 116 aa, Artificial Sequence
  Description of Artificial Sequence: Synthetic polypeptide
QVQLQQSGPVLVKPGASVKMSCKASGYTFTDYYMNWVMQSHGKSLEWIGVINPYNGGTTYNQRFTGKATLTVDKSSSTAYMELNSLTSEDSAVYYCARNYGAMDSWGQGTSVTVSS

SEQ ID NO: 1800 - protein, 107 aa, Artificial Sequence
  Description of Artificial Sequence: Synthetic polypeptide
DIQMTQSPASLSASVGETVTITCRASGNIHNYLAWYQQKQGKSPQLLVSNAKTLADGVPSRFGGSGSGTQYSLKINSLQPEDFGSYYCQHFWITPPTFGAGTRLEIK

SEQ ID NO: 1801 - protein, 446 aa, Artificial Sequence
  Description of Artificial Sequence: Synthetic polypeptide
QVQLQQSGPVLVKPGASVKMSCKASGYTFTDYYMNWVMQSHGKSLEWIGVINPYNGGTTYNQRFTGKATLTVDKSSSTAYMELNSLTSEDSAVYYCARNYGAMDSWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1802 - protein, 214 aa, Artificial Sequence
  Description of Artificial Sequence: Synthetic polypeptide
DIQMTQSPASLSASVGETVTITCRASGNIHNYLAWYQQKQGKSPQLLVSNAKTLADGVPSRFGGSGSGTQYSLKINSLQPEDFGSYYCQHFWITPPTFGAGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1803 - protein, 5 aa, Artificial Sequence
  Description of Artificial Sequence: Synthetic peptide
DYYMN

SEQ ID NO: 1804 - protein, 17 aa, Artificial Sequence
  Description of Artificial Sequence: Synthetic peptide
DINPNGGGTSDNPKFKG

SEQ ID NO: 1805 - protein, 10 aa, Artificial Sequence
  Description of Artificial Sequence: Synthetic peptide
TSGTDWYFDV

SEQ ID NO: 1806 - protein, 11 aa, Artificial Sequence
  Description of Artificial Sequence: Synthetic peptide
KASQNVGTAVA

SEQ ID NO: 1807 - protein, 7 aa, Artificial Sequence
  Description of Artificial Sequence: Synthetic peptide
SASNRYT

SEQ ID NO: 1808 - protein, 9 aa, Artificial Sequence
  Description of Artificial Sequence: Synthetic peptide
QQYSSYPFT

SEQ ID NO: 1809 - protein, 7 aa, Artificial Sequence
  Description of Artificial Sequence: Synthetic peptide
GYKFTDY

SEQ ID NO: 1810 - protein, 6 aa, Artificial Sequence
  Description of Artificial Sequence: Synthetic peptide
NPNGGG

SEQ ID NO: 1811 - protein, 9 aa, Artificial Sequence
  Description of Artificial Sequence: Synthetic peptide
TSGTDWYFD

SEQ ID NO: 1812 - protein, 7 aa, Artificial Sequence
  Description of Artificial Sequence: Synthetic peptide
SQNVGTA

SEQ ID NO: 1813 - protein, 3 aa, Artificial Sequence
  Description of Artificial Sequence: Synthetic peptide
SAS

SEQ ID NO: 1814 - protein, 6 aa, Artificial Sequence
  Description of Artificial Sequence: Synthetic peptide
YSSYPF

SEQ ID NO: 1815 - protein, 10 aa, Artificial Sequence
  Description of Artificial Sequence: Synthetic peptide
GYKFTDYYMN

SEQ ID NO: 1816 - protein, 10 aa, Artificial Sequence
  Description of Artificial Sequence: Synthetic peptide
DINPNGGGTS

SEQ ID NO: 1817 - protein, 10 aa, Artificial Sequence
  Description of Artificial Sequence: Synthetic peptide
TSGTDWYFDV

SEQ ID NO: 1818 - protein, 11 aa, Artificial Sequence
  Description of Artificial Sequence: Synthetic peptide
KASQNVGTAVA

SEQ ID NO: 1819 - protein, 7 aa, Artificial Sequence
  Description of Artificial Sequence: Synthetic peptide
SASNRYT

SEQ ID NO: 1820 - protein, 9 aa, Artificial Sequence
  Description of Artificial Sequence: Synthetic peptide
QQYSSYPFT

SEQ ID NO: 1821 - protein, 6 aa, Artificial Sequence
  Description of Artificial Sequence: Synthetic peptide
TDYYMN

SEQ ID NO: 1822 - protein, 13 aa, Artificial Sequence
  Description of Artificial Sequence: Synthetic peptide
WIGDINPNGGGTS

SEQ ID NO: 1823 - protein, 11 aa, Artificial Sequence
  Description of Artificial Sequence: Synthetic peptide
ARTSGTDWYFD

SEQ ID NO: 1824 - protein, 7 aa, Artificial Sequence
  Description of Artificial Sequence: Synthetic peptide
GTAVAWY

SEQ ID NO: 1825 - protein, 10 aa, Artificial Sequence
  Description of Artificial Sequence: Synthetic peptide
LLIYSASNRY

SEQ ID NO: 1826 - protein, 8 aa, Artificial Sequence
  Description of Artificial Sequence: Synthetic peptide
QQYSSYPF

SEQ ID NO: 1827 - protein, 8 aa, Artificial Sequence
  Description of Artificial Sequence: Synthetic peptide
GYKFTDYY

SEQ ID NO: 1828 - protein, 8 aa, Artificial Sequence
  Description of Artificial Sequence: Synthetic peptide
INPNGGGT

SEQ ID NO: 1829 - protein, 12 aa, Artificial Sequence
  Description of Artificial Sequence: Synthetic peptide
ARTSGTDWYFDV

SEQ ID NO: 1830 - protein, 6 aa, Artificial Sequence
  Description of Artificial Sequence: Synthetic peptide
QNVGTA

SEQ ID NO: 1831 - protein, 3 aa, Artificial Sequence
  Description of Artificial Sequence: Synthetic peptide
SAS

SEQ ID NO: 1832 - protein, 9 aa, Artificial Sequence
  Description of Artificial Sequence: Synthetic peptide
QQYSSYPFT

SEQ ID NO: 1833 - protein, 119 aa, Artificial Sequence
  Description of Artificial Sequence: Synthetic polypeptide
DVQLQESGPELVKPGASVKIACKTSGYKFTDYYMNWVKQSLGKSLDWIGDINPNGGGTSDNPKFKGKATLTVDKSSSTAYMELRSLTSEDSGVYYCARTSGTDWYFDVWGTGTTVTVSS

SEQ ID NO: 1834 - protein, 107 aa, Artificial Sequence
  Description of Artificial Sequence: Synthetic polypeptide
DIVMTQSQKFMSTTVGDRVSITCKASQNVGTAVAWYQQKPGQSPKLLIYSASNRYTGVPDRFTGSGSGTDFTLTISNMQSEDLADYFCQQYSSYPFTFGSGTKLEMK

SEQ ID NO: 1835 - protein, 449 aa, Artificial Sequence
  Description of Artificial Sequence: Synthetic polypeptide
DVQLQESGPELVKPGASVKIACKTSGYKFTDYYMNWVKQSLGKSLDWIGDINPNGGGTSDNPKFKGKATLTVDKSSSTAYMELRSLTSEDSGVYYCARTSGTDWYFDVWGTGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1836 - protein, 214 aa, Artificial Sequence
  Description of Artificial Sequence: Synthetic polypeptide
DIVMTQSQKFMSTTVGDRVSITCKASQNVGTAVAWYQQKPGQSPKLLIYSASNRYTGVPDRFTGSGSGTDFTLTISNMQSEDLADYFCQQYSSYPFTFGSGTKLEMKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1837 - protein, 5 aa, Artificial Sequence
  Description of Artificial Sequence: Synthetic peptide
TAGIQ

SEQ ID NO: 1838 - protein, 17 aa, Artificial Sequence
  Description of Artificial Sequence: Synthetic peptide
WINTHAGESKYADDFKG

SEQ ID NO: 1839 - protein, 12 aa, Artificial Sequence
  Description of Artificial Sequence: Synthetic peptide
SGDYDGSHPFAY

SEQ ID NO: 1840 - protein, 11 aa, Artificial Sequence
  Description of Artificial Sequence: Synthetic peptide
RASQDIRPYLN

SEQ ID NO: 1841 - protein, 7 aa, Artificial Sequence
  Description of Artificial Sequence: Synthetic peptide
YTSRLHS

SEQ ID NO: 1842 - protein, 9 aa, Artificial Sequence
  Description of Artificial Sequence: Synthetic peptide
QQDNTLPYT

SEQ ID NO: 1843 - protein, 7 aa, Artificial Sequence
  Description of Artificial Sequence: Synthetic peptide
GYTFTTA

SEQ ID NO: 1844 - protein, 6 aa, Artificial Sequence
  Description of Artificial Sequence: Synthetic peptide
NTHAGE

SEQ ID NO: 1845 - protein, 11 aa, Artificial Sequence
  Description of Artificial Sequence: Synthetic peptide
SGDYDGSHPFA

SEQ ID NO: 1846 - protein, 7 aa, Artificial Sequence
  Description of Artificial Sequence: Synthetic peptide
SQDIRPY

SEQ ID NO: 1847 - protein, 3 aa, Artificial Sequence
  Description of Artificial Sequence: Synthetic peptide
YTS

SEQ ID NO: 1848 - protein, 6 aa, Artificial Sequence
  Description of Artificial Sequence: Synthetic peptide
DNTLPY

SEQ ID NO: 1849 - protein, 10 aa, Artificial Sequence
  Description of Artificial Sequence: Synthetic peptide
GYTFTTAGIQ

SEQ ID NO: 1850 - protein, 10 aa, Artificial Sequence
  Description of Artificial Sequence: Synthetic peptide
WINTHAGESK

SEQ ID NO: 1851 - protein, 12 aa, Artificial Sequence
  Description of Artificial Sequence: Synthetic peptide
SGDYDGSHPFAY

SEQ ID NO: 1852 - protein, 11 aa, Artificial Sequence
  Description of Artificial Sequence: Synthetic peptide
RASQDIRPYLN

SEQ ID NO: 1853 - protein, 7 aa, Artificial Sequence
  Description of Artificial Sequence: Synthetic peptide
YTSRLHS

SEQ ID NO: 1854 - protein, 9 aa, Artificial Sequence
  Description of Artificial Sequence: Synthetic peptide
QQDNTLPYT

SEQ ID NO: 1855 - protein, 6 aa, Artificial Sequence
  Description of Artificial Sequence: Synthetic peptide
TTAGIQ

SEQ ID NO: 1856 - protein, 13 aa, Artificial Sequence
  Description of Artificial Sequence: Synthetic peptide
WIGWINTHAGESK

SEQ ID NO: 1857 - protein, 13 aa, Artificial Sequence
  Description of Artificial Sequence: Synthetic peptide
ARSGDYDGSHPFA

SEQ ID NO: 1858 - protein, 7 aa, Artificial Sequence
  Description of Artificial Sequence: Synthetic peptide
RPYLNWY

SEQ ID NO: 1859 - protein, 10 aa, Artificial Sequence
  Description of Artificial Sequence: Synthetic peptide
LLIYYTSRLH

SEQ ID NO: 1860 - protein, 8 aa, Artificial Sequence
  Description of Artificial Sequence: Synthetic peptide
QQDNTLPY

SEQ ID NO: 1861 - protein, 8 aa, Artificial Sequence
  Description of Artificial Sequence: Synthetic peptide
GYTFTTAG

SEQ ID NO: 1862 - protein, 8 aa, Artificial Sequence
  Description of Artificial Sequence: Synthetic peptide
INTHAGES

SEQ ID NO: 1863 - protein, 14 aa, Artificial Sequence
  Description of Artificial Sequence: Synthetic peptide
ARSGDYDGSHPFAY

SEQ ID NO: 1864 - protein, 6 aa, Artificial Sequence
  Description of Artificial Sequence: Synthetic peptide
QDIRPY

SEQ ID NO: 1865 - protein, 3 aa, Artificial Sequence
  Description of Artificial Sequence: Synthetic peptide
YTS

SEQ ID NO: 1866 - protein, 9 aa, Artificial Sequence
  Description of Artificial Sequence: Synthetic peptide
QQDNTLPYT

SEQ ID NO: 1867 - protein, 121 aa, Artificial Sequence
  Description of Artificial Sequence: Synthetic polypeptide
QVQLQQSGPELKKPGETVKISCKASGYTFTTAGIQWVQKMPGKGFKWIGWINTHAGESKYADDFKGRFAVSLETSASTAYLQISNLKNEDTATYFCARSGDYDGSHPFAYWGQGTSVTVSS

SEQ ID NO: 1868 - protein, 107 aa, Artificial Sequence
  Description of Artificial Sequence: Synthetic polypeptide
DIQMTQTTSSLSASLGDRVTITCRASQDIRPYLNWYQQKPEGTIKLLIYYTSRLHSGVPSRFSGSGSGTDYSLTISNLEQEDIATYFCQQDNTLPYTFGSGTKLEIK

SEQ ID NO: 1869 - protein, 451 aa, Artificial Sequence
  Description of Artificial Sequence: Synthetic polypeptide
QVQLQQSGPELKKPGETVKISCKASGYTFTTAGIQWVQKMPGKGFKWIGWINTHAGESKYADDFKGRFAVSLETSASTAYLQISNLKNEDTATYFCARSGDYDGSHPFAYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1870 - protein, 214 aa, Artificial Sequence
  Description of Artificial Sequence: Synthetic polypeptide
DIQMTQTTSSLSASLGDRVTITCRASQDIRPYLNWYQQKPEGTIKLLIYYTSRLHSGVPSRFSGSGSGTDYSLTISNLEQEDIATYFCQQDNTLPYTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1871 - protein, 5 aa, Artificial Sequence
  Description of Artificial Sequence: Synthetic peptide
DYYMN

SEQ ID NO: 1872 - protein, 17 aa, Artificial Sequence
  Description of Artificial Sequence: Synthetic peptide
DINPNGGGTSDNPKFKG

SEQ ID NO: 1873 - protein, 10 aa, Artificial Sequence
  Description of Artificial Sequence: Synthetic peptide
TSGTDWYFDV

SEQ ID NO: 1874 - protein, 11 aa, Artificial Sequence
  Description of Artificial Sequence: Synthetic peptide
KASQNVGTAVA

SEQ ID NO: 1875 - protein, 7 aa, Artificial Sequence
  Description of Artificial Sequence: Synthetic peptide
STSNRYT

SEQ ID NO: 1876 - protein, 9 aa, Artificial Sequence
  Description of Artificial Sequence: Synthetic peptide
QQYSIYPFT

SEQ ID NO: 1877 - protein, 7 aa, Artificial Sequence
  Description of Artificial Sequence: Synthetic peptide
GYTFTDY

SEQ ID NO: 1878 - protein, 6 aa, Artificial Sequence
  Description of Artificial Sequence: Synthetic peptide
NPNGGG

SEQ ID NO: 1879 - protein, 9 aa, Artificial Sequence
  Description of Artificial Sequence: Synthetic peptide
TSGTDWYFD

SEQ ID NO: 1880 - protein, 7 aa, Artificial Sequence
  Description of Artificial Sequence: Synthetic peptide
SQNVGTA

SEQ ID NO: 1881 - protein, 3 aa, Artificial Sequence
  Description of Artificial Sequence: Synthetic peptide
STS

SEQ ID NO: 1882 - protein, 6 aa, Artificial Sequence
  Description of Artificial Sequence: Synthetic peptide
YSIYPF

SEQ ID NO: 1883 - protein, 10 aa, Artificial Sequence
  Description of Artificial Sequence: Synthetic peptide
GYTFTDYYMN

SEQ ID NO: 1884 - protein, 10 aa, Artificial Sequence
  Description of Artificial Sequence: Synthetic peptide
DINPNGGGTS

SEQ ID NO: 1885 - protein, 10 aa, Artificial Sequence
  Description of Artificial Sequence: Synthetic peptide
TSGTDWYFDV

SEQ ID NO: 1886 - protein, 11 aa, Artificial Sequence
  Description of Artificial Sequence: Synthetic peptide
KASQNVGTAVA

SEQ ID NO: 1887 - protein, 7 aa, Artificial Sequence
  Description of Artificial Sequence: Synthetic peptide
STSNRYT

SEQ ID NO: 1888 - protein, 9 aa, Artificial Sequence
  Description of Artificial Sequence: Synthetic peptide
QQYSIYPFT

SEQ ID NO: 1889 - protein, 6 aa, Artificial Sequence
  Description of Artificial Sequence: Synthetic peptide
TDYYMN

SEQ ID NO: 1890 - protein, 13 aa, Artificial Sequence
  Description of Artificial Sequence: Synthetic peptide
WIGDINPNGGGTS

SEQ ID NO: 1891 - protein, 11 aa, Artificial Sequence
  Description of Artificial Sequence: Synthetic peptide
ARTSGTDWYFD

SEQ ID NO: 1892 - protein, 7 aa, Artificial Sequence
  Description of Artificial Sequence: Synthetic peptide
GTAVAWY

SEQ ID NO: 1893 - protein, 10 aa, Artificial Sequence
  Description of Artificial Sequence: Synthetic peptide
LLIYSTSNRY

SEQ ID NO: 1894 - protein, 8 aa, Artificial Sequence
  Description of Artificial Sequence: Synthetic peptide
QQYSIYPF

SEQ ID NO: 1895 - protein, 8 aa, Artificial Sequence
  Description of Artificial Sequence: Synthetic peptide
GYTFTDYY

SEQ ID NO: 1896 - protein, 8 aa, Artificial Sequence
  Description of Artificial Sequence: Synthetic peptide
INPNGGGT

SEQ ID NO: 1897 - protein, 12 aa, Artificial Sequence
  Description of Artificial Sequence: Synthetic peptide
ARTSGTDWYFDV

SEQ ID NO: 1898 - protein, 6 aa, Artificial Sequence
  Description of Artificial Sequence: Synthetic peptide
QNVGTA

SEQ ID NO: 1899 - protein, 3 aa, Artificial Sequence
  Description of Artificial Sequence: Synthetic peptide
STS

SEQ ID NO: 1900 - protein, 9 aa, Artificial Sequence
  Description of Artificial Sequence: Synthetic peptide
QQYSIYPFT

SEQ ID NO: 1901 - protein, 119 aa, Artificial Sequence
  Description of Artificial Sequence: Synthetic polypeptide
QIQLVQSGPELVKPGASVKISCKASGYTFTDYYMNWVKQSHGKSLDWIGDINPNGGGTSDNPKFKGKATLTVDKSSNTAYMELRSLTSEDSAVYYCARTSGTDWYFDVWGTGTLVTVSA

SEQ ID NO: 1902 - protein, 107 aa, Artificial Sequence
  Description of Artificial Sequence: Synthetic polypeptide
DIVMTQSQKFMSTTVGDRVSITCKASQNVGTAVAWYQQKPGQSPKLLIYSTSNRYTGVPDRFTGSGSGTDFTLTISNMQSEDLADYFCQQYSIYPFTFGSGTKLEMK

SEQ ID NO: 1903 - protein, 449 aa, Artificial Sequence
  Description of Artificial Sequence: Synthetic polypeptide
QIQLVQSGPELVKPGASVKISCKASGYTFTDYYMNWVKQSHGKSLDWIGDINPNGGGTSDNPKFKGKATLTVDKSSNTAYMELRSLTSEDSAVYYCARTSGTDWYFDVWGTGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1904 - protein, 214 aa, Artificial Sequence
  Description of Artificial Sequence: Synthetic polypeptide
DIVMTQSQKFMSTTVGDRVSITCKASQNVGTAVAWYQQKPGQSPKLLIYSTSNRYTGVPDRFTGSGSGTDFTLTISNMQSEDLADYFCQQYSIYPFTFGSGTKLEMKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1905 - protein, 5 aa, Artificial Sequence
  Description of Artificial Sequence: Synthetic peptide
DYYMS

SEQ ID NO: 1906 - protein, 19 aa, Artificial Sequence
  Description of Artificial Sequence: Synthetic peptide
LSRNKGNGYTTEYSASVKG

SEQ ID NO: 1907 - protein, 13 aa, Artificial Sequence
  Description of Artificial Sequence: Synthetic peptide
TVTGTLFYYALDY

SEQ ID NO: 1908 - protein, 11 aa, Artificial Sequence
  Description of Artificial Sequence: Synthetic peptide
RASENIYSYLA

SEQ ID NO: 1909 - protein, 7 aa, Artificial Sequence
  Description of Artificial Sequence: Synthetic peptide
NAKTLAA

SEQ ID NO: 1910 - protein, 9 aa, Artificial Sequence
  Description of Artificial Sequence: Synthetic peptide
QHHYGTPLT

SEQ ID NO: 1911 - protein, 7 aa, Artificial Sequence
  Description of Artificial Sequence: Synthetic peptide
GFTFTDY

SEQ ID NO: 1912 - protein, 8 aa, Artificial Sequence
  Description of Artificial Sequence: Synthetic peptide
RNKGNGYT

SEQ ID NO: 1913 - protein, 12 aa, Artificial Sequence
  Description of Artificial Sequence: Synthetic peptide
TVTGTLFYYALD

SEQ ID NO: 1914 - protein, 7 aa, Artificial Sequence
  Description of Artificial Sequence: Synthetic peptide
SENIYSY

SEQ ID NO: 1915 - protein, 3 aa, Artificial Sequence
  Description of Artificial Sequence: Synthetic peptide
NAK

SEQ ID NO: 1916 - protein, 6 aa, Artificial Sequence
  Description of Artificial Sequence: Synthetic peptide
HYGTPL

SEQ ID NO: 1917 - protein, 10 aa, Artificial Sequence
  Description of Artificial Sequence: Synthetic peptide
GFTFTDYYMS

SEQ ID NO: 1918 - protein, 12 aa, Artificial Sequence
  Description of Artificial Sequence: Synthetic peptide
LSRNKGNGYTTE

SEQ ID NO: 1919 - protein, 13 aa, Artificial Sequence
  Description of Artificial Sequence: Synthetic peptide
TVTGTLFYYALDY

SEQ ID NO: 1920 - protein, 11 aa, Artificial Sequence
  Description of Artificial Sequence: Synthetic peptide
RASENIYSYLA

SEQ ID NO: 1921 - protein, 7 aa, Artificial Sequence
  Description of Artificial Sequence: Synthetic peptide
NAKTLAA

SEQ ID NO: 1922 - protein, 9 aa, Artificial Sequence
  Description of Artificial Sequence: Synthetic peptide
QHHYGTPLT

SEQ ID NO: 1923 - protein, 6 aa, Artificial Sequence
  Description of Artificial Sequence: Synthetic peptide
TDYYMS

SEQ ID NO: 1924 - protein, 15 aa, Artificial Sequence
  Description of Artificial Sequence: Synthetic peptide
WLALSRNKGNGYTTE

SEQ ID NO: 1925 - protein, 14 aa, Artificial Sequence
  Description of Artificial Sequence: Synthetic peptide
ARTVTGTLFYYALD

SEQ ID NO: 1926 - protein, 7 aa, Artificial Sequence
  Description of Artificial Sequence: Synthetic peptide
YSYLAWY

SEQ ID NO: 1927 - protein, 10 aa, Artificial Sequence
  Description of Artificial Sequence: Synthetic peptide
FLVYNAKTLA

SEQ ID NO: 1928 - protein, 8 aa, Artificial Sequence
  Description of Artificial Sequence: Synthetic peptide
QHHYGTPL

SEQ ID NO: 1929 - protein, 8 aa, Artificial Sequence
  Description of Artificial Sequence: Synthetic peptide
GFTFTDYY

SEQ ID NO: 1930 - protein, 10 aa, Artificial Sequence
  Description of Artificial Sequence: Synthetic peptide
SRNKGNGYTT

SEQ ID NO: 1931 - protein, 15 aa, Artificial Sequence
  Description of Artificial Sequence: Synthetic peptide
ARTVTGTLFYYALDY

SEQ ID NO: 1932 - protein, 6 aa, Artificial Sequence
  Description of Artificial Sequence: Synthetic peptide
ENIYSY

SEQ ID NO: 1933 - protein, 3 aa, Artificial Sequence
  Description of Artificial Sequence: Synthetic peptide
NAK

SEQ ID NO: 1934 - protein, 9 aa, Artificial Sequence
  Description of Artificial Sequence: Synthetic peptide
QHHYGTPLT

SEQ ID NO: 1935 - protein, 124 aa, Artificial Sequence
  Description of Artificial Sequence: Synthetic polypeptide
EFQLQQSGGGLVQPGGSLSLSCAAPGFTFTDYYMSWVRQSPGKALEWLALSRNKGNGYTTEYSASVKGRFTISRDNSQSILYLQMNVLRAEDSATYYCARTVTGTLFYYALDYWGQGTTVTVSS

SEQ ID NO: 1936 - protein, 107 aa, Artificial Sequence
  Description of Artificial Sequence: Synthetic polypeptide
DIQMTQSPASLSASVGETVTITCRASENIYSYLAWYQQKQGKSPQFLVYNAKTLAAGVPSRFSGSGSGTQFSLKINRLQPEDFGTYYCQHHYGTPLTFGDGTRLEIK

SEQ ID NO: 1937 - protein, 454 aa, Artificial Sequence
  Description of Artificial Sequence: Synthetic polypeptide
EFQLQQSGGGLVQPGGSLSLSCAAPGFTFTDYYMSWVRQSPGKALEWLALSRNKGNGYTTEYSASVKGRFTISRDNSQSILYLQMNVLRAEDSATYYCARTVTGTLFYYALDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1938 - protein, 214 aa, Artificial Sequence
  Description of Artificial Sequence: Synthetic polypeptide
DIQMTQSPASLSASVGETVTITCRASENIYSYLAWYQQKQGKSPQFLVYNAKTLAAGVPSRFSGSGSGTQFSLKINRLQPEDFGTYYCQHHYGTPLTFGDGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1939 - protein, 5 aa, Artificial Sequence
  Description of Artificial Sequence: Synthetic peptide
TYTMH

SEQ ID NO: 1940 - protein, 17 aa, Artificial Sequence
  Description of Artificial Sequence: Synthetic peptide
YINPSSGYTKYNQKFTD

SEQ ID NO: 1941 - protein, 4 aa, Artificial Sequence
  Description of Artificial Sequence: Synthetic peptide
LWAY

SEQ ID NO: 1942 - protein, 16 aa, Artificial Sequence
  Description of Artificial Sequence: Synthetic peptide
RSSQSLVHSSGNTYLH

SEQ ID NO: 1943 - protein, 7 aa, Artificial Sequence
  Description of Artificial Sequence: Synthetic peptide
KGSNRFS

SEQ ID NO: 1944 - protein, 9 aa, Artificial Sequence
  Description of Artificial Sequence: Synthetic peptide
SQSTHVPFT

SEQ ID NO: 1945 - protein, 7 aa, Artificial Sequence
  Description of Artificial Sequence: Synthetic peptide
GYTFTTY

SEQ ID NO: 1946 - protein, 6 aa, Artificial Sequence
  Description of Artificial Sequence: Synthetic peptide
NPSSGY

SEQ ID NO: 1947 - protein, 3 aa, Artificial Sequence
  Description of Artificial Sequence: Synthetic peptide
LWA

SEQ ID NO: 1948 - protein, 12 aa, Artificial Sequence
  Description of Artificial Sequence: Synthetic peptide
SQSLVHSSGNTY

SEQ ID NO: 1949 - protein, 3 aa, Artificial Sequence
  Description of Artificial Sequence: Synthetic peptide
KGS

SEQ ID NO: 1950 - protein, 6 aa, Artificial Sequence
  Description of Artificial Sequence: Synthetic peptide
STHVPF

SEQ ID NO: 1951 - protein, 10 aa, Artificial Sequence
  Description of Artificial Sequence: Synthetic peptide
GYTFTTYTMH

SEQ ID NO: 1952 - protein, 10 aa, Artificial Sequence
  Description of Artificial Sequence: Synthetic peptide
YINPSSGYTK

SEQ ID NO: 1953 - protein, 4 aa, Artificial Sequence
  Description of Artificial Sequence: Synthetic peptide
LWAY

SEQ ID NO: 1954 - protein, 16 aa, Artificial Sequence
  Description of Artificial Sequence: Synthetic peptide
RSSQSLVHSSGNTYLH

SEQ ID NO: 1955 - protein, 7 aa, Artificial Sequence
  Description of Artificial Sequence: Synthetic peptide
KGSNRFS

SEQ ID NO: 1956 - protein, 9 aa, Artificial Sequence
  Description of Artificial Sequence: Synthetic peptide
SQSTHVPFT

SEQ ID NO: 1957 - protein, 6 aa, Artificial Sequence
  Description of Artificial Sequence: Synthetic peptide
TTYTMH

SEQ ID NO: 1958 - protein, 13 aa, Artificial Sequence
  Description of Artificial Sequence: Synthetic peptide
WIGYINPSSGYTK

SEQ ID NO: 1959 - protein, 5 aa, Artificial Sequence
  Description of Artificial Sequence: Synthetic peptide
ARLWA

SEQ ID NO: 1960 - protein, 12 aa, Artificial Sequence
  Description of Artificial Sequence: Synthetic peptide
VHSSGNTYLHWY

SEQ ID NO: 1961 - protein, 10 aa, Artificial Sequence
  Description of Artificial Sequence: Synthetic peptide
LLIYKGSNRF

SEQ ID NO: 1962 - protein, 8 aa, Artificial Sequence
  Description of Artificial Sequence: Synthetic peptide
SQSTHVPF

SEQ ID NO: 1963 - protein, 8 aa, Artificial Sequence
  Description of Artificial Sequence: Synthetic peptide
GYTFTTYT

SEQ ID NO: 1964 - protein, 8 aa, Artificial Sequence
  Description of Artificial Sequence: Synthetic peptide
INPSSGYT

SEQ ID NO: 1965 - protein, 6 aa, Artificial Sequence
  Description of Artificial Sequence: Synthetic peptide
ARLWAY

SEQ ID NO: 1966 - protein, 11 aa, Artificial Sequence
  Description of Artificial Sequence: Synthetic peptide
QSLVHSSGNTY

SEQ ID NO: 1967 - protein, 3 aa, Artificial Sequence
  Description of Artificial Sequence: Synthetic peptide
KGS

SEQ ID NO: 1968 - protein, 9 aa, Artificial Sequence
  Description of Artificial Sequence: Synthetic peptide
SQSTHVPFT

SEQ ID NO: 1969 - protein, 113 aa, Artificial Sequence
  Description of Artificial Sequence: Synthetic polypeptide
EVQLQQSGAELARPGASVKMSCKASGYTFTTYTMHWVKQRPGQGLEWIGYINPSSGYTKYNQKFTDKATLTADKSSSTAYMQLSSLTSEDSAVYYCARLWAYWGQGTLVTVSA

SEQ ID NO: 1970 - protein, 112 aa, Artificial Sequence
  Description of Artificial Sequence: Synthetic polypeptide
DVVMTQTPLSLPVSLGDQASISCRSSQSLVHSSGNTYLHWYLQKPGQSPKLLIYKGSNRFSGVSDRFSGSGSGTDFTLKISRVEAEDLGVYFCSQSTHVPFTFGSGTKLEMK

SEQ ID NO: 1971 - protein, 443 aa, Artificial Sequence
  Description of Artificial Sequence: Synthetic polypeptide
EVQLQQSGAELARPGASVKMSCKASGYTFTTYTMHWVKQRPGQGLEWIGYINPSSGYTKYNQKFTDKATLTADKSSSTAYMQLSSLTSEDSAVYYCARLWAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1972 - protein, 219 aa, Artificial Sequence
  Description of Artificial Sequence: Synthetic polypeptide
DVVMTQTPLSLPVSLGDQASISCRSSQSLVHSSGNTYLHWYLQKPGQSPKLLIYKGSNRFSGVSDRFSGSGSGTDFTLKISRVEAEDLGVYFCSQSTHVPFTFGSGTKLEMKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1973 - protein, 5 aa, Artificial Sequence
  Description of Artificial Sequence: Synthetic peptide
NYVVH

SEQ ID NO: 1974 - protein, 16 aa, Artificial Sequence
  Description of Artificial Sequence: Synthetic peptide
VIWTDGSTDYNAAFIS

SEQ ID NO: 1975 - protein, 11 aa, Artificial Sequence
  Description of Artificial Sequence: Synthetic peptide
NNGYFPAFFAY

SEQ ID NO: 1976 - protein, 11 aa, Artificial Sequence
  Description of Artificial Sequence: Synthetic peptide
KASQNVDTDIT

SEQ ID NO: 1977 - protein, 7 aa, Artificial Sequence
  Description of Artificial Sequence: Synthetic peptide
SASYRYS

SEQ ID NO: 1978 - protein, 9 aa, Artificial Sequence
  Description of Artificial Sequence: Synthetic peptide
QQYNSYPLT

SEQ ID NO: 1979 - protein, 7 aa, Artificial Sequence
  Description of Artificial Sequence: Synthetic peptide
GFSLSNY

SEQ ID NO: 1980 - protein, 5 aa, Artificial Sequence
  Description of Artificial Sequence: Synthetic peptide
WTDGS

SEQ ID NO: 1981 - protein, 10 aa, Artificial Sequence
  Description of Artificial Sequence: Synthetic peptide
NNGYFPAFFA

SEQ ID NO: 1982 - protein, 7 aa, Artificial Sequence
  Description of Artificial Sequence: Synthetic peptide
SQNVDTD

SEQ ID NO: 1983 - protein, 3 aa, Artificial Sequence
  Description of Artificial Sequence: Synthetic peptide
SAS

SEQ ID NO: 1984 - protein, 6 aa, Artificial Sequence
  Description of Artificial Sequence: Synthetic peptide
YNSYPL

SEQ ID NO: 1985 - protein, 10 aa, Artificial Sequence
  Description of Artificial Sequence: Synthetic peptide
GFSLSNYVVH

SEQ ID NO: 1986 - protein, 9 aa, Artificial Sequence
  Description of Artificial Sequence: Synthetic peptide
VIWTDGSTD

SEQ ID NO: 1987 - protein, 11 aa, Artificial Sequence
  Description of Artificial Sequence: Synthetic peptide
NNGYFPAFFAY

SEQ ID NO: 1988 - protein, 11 aa, Artificial Sequence
  Description of Artificial Sequence: Synthetic peptide
KASQNVDTDIT

SEQ ID NO: 1989 - protein, 7 aa, Artificial Sequence
  Description of Artificial Sequence: Synthetic peptide
SASYRYS

SEQ ID NO: 1990 - protein, 9 aa, Artificial Sequence
  Description of Artificial Sequence: Synthetic peptide
QQYNSYPLT

SEQ ID NO: 1991 - protein, 6 aa, Artificial Sequence
  Description of Artificial Sequence: Synthetic peptide
SNYVVH

SEQ ID NO: 1992 - protein, 12 aa, Artificial Sequence
  Description of Artificial Sequence: Synthetic peptide
WLGVIWTDGSTD

SEQ ID NO: 1993 - protein, 12 aa, Artificial Sequence
  Description of Artificial Sequence: Synthetic peptide
ARNNGYFPAFFA

SEQ ID NO: 1994 - protein, 7 aa, Artificial Sequence
  Description of Artificial Sequence: Synthetic peptide
DTDITWY

SEQ ID NO: 1995 - protein, 10 aa, Artificial Sequence
  Description of Artificial Sequence: Synthetic peptide
ALIYSASYRY

SEQ ID NO: 1996 - protein, 8 aa, Artificial Sequence
  Description of Artificial Sequence: Synthetic peptide
QQYNSYPL

SEQ ID NO: 1997 - protein, 8 aa, Artificial Sequence
  Description of Artificial Sequence: Synthetic peptide
GFSLSNYV

SEQ ID NO: 1998 - protein, 7 aa, Artificial Sequence
  Description of Artificial Sequence: Synthetic peptide
IWTDGST

SEQ ID NO: 1999 - protein, 13 aa, Artificial Sequence
  Description of Artificial Sequence: Synthetic peptide
ARNNGYFPAFFAY

SEQ ID NO: 2000 - protein, 6 aa, Artificial Sequence
  Description of Artificial Sequence: Synthetic peptide
QNVDTD

SEQ ID NO: 2001 - protein, 3 aa, Artificial Sequence
  Description of Artificial Sequence: Synthetic peptide
SAS

SEQ ID NO: 2002 - protein, 9 aa, Artificial Sequence
  Description of Artificial Sequence: Synthetic peptide
QQYNSYPLT

SEQ ID NO: 2003 - protein, 119 aa, Artificial Sequence
  Description of Artificial Sequence: Synthetic polypeptide
QVQLKESGPGLVAPSQSLSITCTVSGFSLSNYVVHWVRQSPGKGLEWLGVIWTDGSTDYNAAFISRLSISKDNSKSQVFFKMNSLQADDTAIYYCARNNGYFPAFFAYWGQGTLVTVSA

SEQ ID NO: 2004 - protein, 107 aa, Artificial Sequence
  Description of Artificial Sequence: Synthetic polypeptide
DIVMTQSQKFMSTSVGDRVSVTCKASQNVDTDITWYQQKPGQSPKALIYSASYRYSGVPDRFTGSGSGTDFTLTITNVQSEDLAEYFCQQYNSYPLTFGSGTKLEMK

SEQ ID NO: 2005 - protein, 449 aa, Artificial Sequence
  Description of Artificial Sequence: Synthetic polypeptide
QVQLKESGPGLVAPSQSLSITCTVSGFSLSNYVVHWVRQSPGKGLEWLGVIWTDGSTDYNAAFISRLSISKDNSKSQVFFKMNSLQADDTAIYYCARNNGYFPAFFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2006 - protein, 214 aa, Artificial Sequence
  Description of Artificial Sequence: Synthetic polypeptide
DIVMTQSQKFMSTSVGDRVSVTCKASQNVDTDITWYQQKPGQSPKALIYSASYRYSGVPDRFTGSGSGTDFTLTITNVQSEDLAEYFCQQYNSYPLTFGSGTKLEMKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2007 - protein, 5 aa, Artificial Sequence
  Description of Artificial Sequence: Synthetic peptide
SYWIT

SEQ ID NO: 2008 - protein, 17 aa, Artificial Sequence
  Description of Artificial Sequence: Synthetic peptide
DIYPGSGSTNYNEKFKS

SEQ ID NO: 2009 - protein, 12 aa, Artificial Sequence
  Description of Artificial Sequence: Synthetic peptide
ESITTRITPFDH

SEQ ID NO: 2010 - protein, 16 aa, Artificial Sequence
  Description of Artificial Sequence: Synthetic peptide
RSSQSLVHSSGNTYLH

SEQ ID NO: 2011 - protein, 7 aa, Artificial Sequence
  Description of Artificial Sequence: Synthetic peptide
KGSNRFS

SEQ ID NO: 2012 - protein, 9 aa, Artificial Sequence
  Description of Artificial Sequence: Synthetic peptide
SQSTHVPFT

SEQ ID NO: 2013 - protein, 7 aa, Artificial Sequence
  Description of Artificial Sequence: Synthetic peptide
GYTFSSY

SEQ ID NO: 2014 - protein, 6 aa, Artificial Sequence
  Description of Artificial Sequence: Synthetic peptide
YPGSGS

SEQ ID NO: 2015 - protein, 11 aa, Artificial Sequence
  Description of Artificial Sequence: Synthetic peptide
ESITTRITPFD

SEQ ID NO: 2016 - protein, 12 aa, Artificial Sequence
  Description of Artificial Sequence: Synthetic peptide
SQSLVHSSGNTY

SEQ ID NO: 2017 - protein, 3 aa, Artificial Sequence
  Description of Artificial Sequence: Synthetic peptide
KGS

SEQ ID NO: 2018 - protein, 6 aa, Artificial Sequence
  Description of Artificial Sequence: Synthetic peptide
STHVPF

SEQ ID NO: 2019 - protein, 10 aa, Artificial Sequence
  Description of Artificial Sequence: Synthetic peptide
GYTFSSYWIT

SEQ ID NO: 2020 - protein, 10 aa, Artificial Sequence
  Description of Artificial Sequence: Synthetic peptide
DIYPGSGSTN

SEQ ID NO: 2021 - protein, 12 aa, Artificial Sequence
  Description of Artificial Sequence: Synthetic peptide
ESITTRITPFDH

SEQ ID NO: 2022 - protein, 16 aa, Artificial Sequence
  Description of Artificial Sequence: Synthetic peptide
RSSQSLVHSSGNTYLH

SEQ ID NO: 2023 - protein, 7 aa, Artificial Sequence
  Description of Artificial Sequence: Synthetic peptide
KGSNRFS

SEQ ID NO: 2024 - protein, 9 aa, Artificial Sequence
  Description of Artificial Sequence: Synthetic peptide
SQSTHVPFT

SEQ ID NO: 2025 - protein, 6 aa, Artificial Sequence
  Description of Artificial Sequence: Synthetic peptide
SSYWIT

SEQ ID NO: 2026 - protein, 13 aa, Artificial Sequence
  Description of Artificial Sequence: Synthetic peptide
WVGDIYPGSGSTN

SEQ ID NO: 2027 - protein, 13 aa, Artificial Sequence
  Description of Artificial Sequence: Synthetic peptide
ARESITTRITPFD

SEQ ID NO: 2028 - protein, 12 aa, Artificial Sequence
  Description of Artificial Sequence: Synthetic peptide
VHSSGNTYLHWY

SEQ ID NO: 2029 - protein, 10 aa, Artificial Sequence
  Description of Artificial Sequence: Synthetic peptide
LLIYKGSNRF

SEQ ID NO: 2030 - protein, 8 aa, Artificial Sequence
  Description of Artificial Sequence: Synthetic peptide
SQSTHVPF

SEQ ID NO: 2031 - protein, 8 aa, Artificial Sequence
  Description of Artificial Sequence: Synthetic peptide
GYTFSSYW

SEQ ID NO: 2032 - protein, 8 aa, Artificial Sequence
  Description of Artificial Sequence: Synthetic peptide
IYPGSGST

SEQ ID NO: 2033 - protein, 14 aa, Artificial Sequence
  Description of Artificial Sequence: Synthetic peptide
ARESITTRITPFDH

SEQ ID NO: 2034 - protein, 11 aa, Artificial Sequence
  Description of Artificial Sequence: Synthetic peptide
QSLVHSSGNTY

SEQ ID NO: 2035 - protein, 3 aa, Artificial Sequence
  Description of Artificial Sequence: Synthetic peptide
KGS

SEQ ID NO: 2036 - protein, 9 aa, Artificial Sequence
  Description of Artificial Sequence: Synthetic peptide
SQSTHVPFT

SEQ ID NO: 2037 - protein, 121 aa, Artificial Sequence
  Description of Artificial Sequence: Synthetic polypeptide
EVQLQQSGAELVKPGASVKMSCKTSGYTFSSYWITWVKQRPGQGLEWVGDIYPGSGSTNYNEKFKSKAALTVDTSSSTAFMQLNSLTSEDSAVYYCARESITTRITPFDHWGQGTTLTVSS

SEQ ID NO: 2038 - protein, 112 aa, Artificial Sequence
  Description of Artificial Sequence: Synthetic polypeptide
DVVMTQTPLSLPVSLGDQASISCRSSQSLVHSSGNTYLHWYLQKPGQSPKLLIYKGSNRFSGVSDRFSGSGSGTDFTLKISRVEAEDLGVYFCSQSTHVPFTFGSGTKLEIK

SEQ ID NO: 2039 - protein, 451 aa, Artificial Sequence
  Description of Artificial Sequence: Synthetic polypeptide
EVQLQQSGAELVKPGASVKMSCKTSGYTFSSYWITWVKQRPGQGLEWVGDIYPGSGSTNYNEKFKSKAALTVDTSSSTAFMQLNSLTSEDSAVYYCARESITTRITPFDHWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2040 - protein, 219 aa, Artificial Sequence
  Description of Artificial Sequence: Synthetic polypeptide
DVVMTQTPLSLPVSLGDQASISCRSSQSLVHSSGNTYLHWYLQKPGQSPKLLIYKGSNRFSGVSDRFSGSGSGTDFTLKISRVEAEDLGVYFCSQSTHVPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2041 - protein, 5 aa, Artificial Sequence
  Description of Artificial Sequence: Synthetic peptide
SYWIN

SEQ ID NO: 2042 - protein, 17 aa, Artificial Sequence
  Description of Artificial Sequence: Synthetic peptide
NIYPGSSSTNYNEKFKS

SEQ ID NO: 2043 - protein, 13 aa, Artificial Sequence
  Description of Artificial Sequence: Synthetic peptide
ELGGYYRYNAMDY

SEQ ID NO: 2044 - protein, 11 aa, Artificial Sequence
  Description of Artificial Sequence: Synthetic peptide
KASQDINRYLS

SEQ ID NO: 2045 - protein, 7 aa, Artificial Sequence
  Description of Artificial Sequence: Synthetic peptide
RANTLVD

SEQ ID NO: 2046 - protein, 9 aa, Artificial Sequence
  Description of Artificial Sequence: Synthetic peptide
LQYDEFPYT

SEQ ID NO: 2047 - protein, 7 aa, Artificial Sequence
  Description of Artificial Sequence: Synthetic peptide
GYTFNSY

SEQ ID NO: 2048 - protein, 6 aa, Artificial Sequence
  Description of Artificial Sequence: Synthetic peptide
YPGSSS

SEQ ID NO: 2049 - protein, 12 aa, Artificial Sequence
  Description of Artificial Sequence: Synthetic peptide
ELGGYYRYNAMD

SEQ ID NO: 2050 - protein, 7 aa, Artificial Sequence
  Description of Artificial Sequence: Synthetic peptide
SQDINRY

SEQ ID NO: 2051 - protein, 3 aa, Artificial Sequence
  Description of Artificial Sequence: Synthetic peptide
RAN

SEQ ID NO: 2052 - protein, 6 aa, Artificial Sequence
  Description of Artificial Sequence: Synthetic peptide
YDEFPY

SEQ ID NO: 2053 - protein, 10 aa, Artificial Sequence
  Description of Artificial Sequence: Synthetic peptide
GYTFNSYWIN

SEQ ID NO: 2054 - protein, 10 aa, Artificial Sequence
  Description of Artificial Sequence: Synthetic peptide
NIYPGSSSTN

SEQ ID NO: 2055 - protein, 13 aa, Artificial Sequence
  Description of Artificial Sequence: Synthetic peptide
ELGGYYRYNAMDY

SEQ ID NO: 2056 - protein, 11 aa, Artificial Sequence
  Description of Artificial Sequence: Synthetic peptide
KASQDINRYLS

SEQ ID NO: 2057 - protein, 7 aa, Artificial Sequence
  Description of Artificial Sequence: Synthetic peptide
RANTLVD

SEQ ID NO: 2058 - protein, 9 aa, Artificial Sequence
  Description of Artificial Sequence: Synthetic peptide
LQYDEFPYT

SEQ ID NO: 2059 - protein, 6 aa, Artificial Sequence
  Description of Artificial Sequence: Synthetic peptide
NSYWIN

SEQ ID NO: 2060 - protein, 13 aa, Artificial Sequence
  Description of Artificial Sequence: Synthetic peptide
WIGNIYPGSSSTN

SEQ ID NO: 2061 - protein, 14 aa, Artificial Sequence
  Description of Artificial Sequence: Synthetic peptide
ARELGGYYRYNAMD

SEQ ID NO: 2062 - protein, 7 aa, Artificial Sequence
  Description of Artificial Sequence: Synthetic peptide
NRYLSWF

SEQ ID NO: 2063 - protein, 10 aa, Artificial Sequence
  Description of Artificial Sequence: Synthetic peptide
TLIYRANTLV

SEQ ID NO: 2064 - protein, 8 aa, Artificial Sequence
  Description of Artificial Sequence: Synthetic peptide
LQYDEFPY

SEQ ID NO: 2065 - protein, 8 aa, Artificial Sequence
  Description of Artificial Sequence: Synthetic peptide
GYTFNSYW

SEQ ID NO: 2066 - protein, 8 aa, Artificial Sequence
  Description of Artificial Sequence: Synthetic peptide
IYPGSSST

SEQ ID NO: 2067 - protein, 15 aa, Artificial Sequence
  Description of Artificial Sequence: Synthetic peptide
ARELGGYYRYNAMDY

SEQ ID NO: 2068 - protein, 6 aa, Artificial Sequence
  Description of Artificial Sequence: Synthetic peptide
QDINRY

SEQ ID NO: 2069 - protein, 3 aa, Artificial Sequence
  Description of Artificial Sequence: Synthetic peptide
RAN

SEQ ID NO: 2070 - protein, 9 aa, Artificial Sequence
  Description of Artificial Sequence: Synthetic peptide
LQYDEFPYT

SEQ ID NO: 2071 - protein, 122 aa, Artificial Sequence
  Description of Artificial Sequence: Synthetic polypeptide
QVQLQQPGAELVKPGASVKLSCKASGYTFNSYWINWMKQRPGQGLEWIGNIYPGSSSTNYNEKFKSKATLTVDTSSSTAYMQLSSLTSDDSAVYYCARELGGYYRYNAMDYWGQGTSVTVSS

SEQ ID NO: 2072 - protein, 107 aa, Artificial Sequence
  Description of Artificial Sequence: Synthetic polypeptide
DIVLTQSPSSMYASLGERVTITCKASQDINRYLSWFQQKPGKSPKTLIYRANTLVDGVPSRFSGSGSGQDYSLTISSLEYEDMGIYYCLQYDEFPYTFGSGTKLEMK

SEQ ID NO: 2073 - protein, 452 aa, Artificial Sequence
  Description of Artificial Sequence: Synthetic polypeptide
QVQLQQPGAELVKPGASVKLSCKASGYTFNSYWINWMKQRPGQGLEWIGNIYPGSSSTNYNEKFKSKATLTVDTSSSTAYMQLSSLTSDDSAVYYCARELGGYYRYNAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2074 - protein, 214 aa, Artificial Sequence
  Description of Artificial Sequence: Synthetic polypeptide
DIVLTQSPSSMYASLGERVTITCKASQDINRYLSWFQQKPGKSPKTLIYRANTLVDGVPSRFSGSGSGQDYSLTISSLEYEDMGIYYCLQYDEFPYTFGSGTKLEMKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2075 - protein, 5 aa, Artificial Sequence
  Description of Artificial Sequence: Synthetic peptide
SYWMH

SEQ ID NO: 2076 - protein, 17 aa, Artificial Sequence
  Description of Artificial Sequence: Synthetic peptide
MIHPNSGSTNYNEKFKS

SEQ ID NO: 2077 - protein, 10 aa, Artificial Sequence
  Description of Artificial Sequence: Synthetic peptide
CGYDGAWFAY

SEQ ID NO: 2078 - protein, 11 aa, Artificial Sequence
  Description of Artificial Sequence: Synthetic peptide
SASQGISNCLN

SEQ ID NO: 2079 - protein, 7 aa, Artificial Sequence
  Description of Artificial Sequence: Synthetic peptide
YTSSLHS

SEQ ID NO: 2080 - protein, 9 aa, Artificial Sequence
  Description of Artificial Sequence: Synthetic peptide
QQYSKVPYT

SEQ ID NO: 2081 - protein, 7 aa, Artificial Sequence
  Description of Artificial Sequence: Synthetic peptide
GYTFTSY

SEQ ID NO: 2082 - protein, 6 aa, Artificial Sequence
  Description of Artificial Sequence: Synthetic peptide
HPNSGS

SEQ ID NO: 2083 - protein, 9 aa, Artificial Sequence
  Description of Artificial Sequence: Synthetic peptide
CGYDGAWFA

SEQ ID NO: 2084 - protein, 7 aa, Artificial Sequence
  Description of Artificial Sequence: Synthetic peptide
SQGISNC

SEQ ID NO: 2085 - protein, 3 aa, Artificial Sequence
  Description of Artificial Sequence: Synthetic peptide
YTS

SEQ ID NO: 2086 - protein, 6 aa, Artificial Sequence
  Description of Artificial Sequence: Synthetic peptide
YSKVPY

SEQ ID NO: 2087 - protein, 10 aa, Artificial Sequence
  Description of Artificial Sequence: Synthetic peptide
GYTFTSYWMH

SEQ ID NO: 2088 - protein, 10 aa, Artificial Sequence
  Description of Artificial Sequence: Synthetic peptide
MIHPNSGSTN

SEQ ID NO: 2089 - protein, 10 aa, Artificial Sequence
  Description of Artificial Sequence: Synthetic peptide
CGYDGAWFAY

SEQ ID NO: 2090 - protein, 11 aa, Artificial Sequence
  Description of Artificial Sequence: Synthetic peptide
SASQGISNCLN

SEQ ID NO: 2091 - protein, 7 aa, Artificial Sequence
  Description of Artificial Sequence: Synthetic peptide
YTSSLHS

SEQ ID NO: 2092 - protein, 9 aa, Artificial Sequence
  Description of Artificial Sequence: Synthetic peptide
QQYSKVPYT

SEQ ID NO: 2093 - protein, 6 aa, Artificial Sequence
  Description of Artificial Sequence: Synthetic peptide
TSYWMH

SEQ ID NO: 2094 - protein, 13 aa, Artificial Sequence
  Description of Artificial Sequence: Synthetic peptide
WIGMIHPNSGSTN

SEQ ID NO: 2095 - protein, 11 aa, Artificial Sequence
  Description of Artificial Sequence: Synthetic peptide
ARCGYDGAWFA

SEQ ID NO: 2096 - protein, 7 aa, Artificial Sequence
  Description of Artificial Sequence: Synthetic peptide
SNCLNWY

SEQ ID NO: 2097 - protein, 10 aa, Artificial Sequence
  Description of Artificial Sequence: Synthetic peptide
LLIHYTSSLH

SEQ ID NO: 2098 - protein, 8 aa, Artificial Sequence
  Description of Artificial Sequence: Synthetic peptide
QQYSKVPY

SEQ ID NO: 2099 - protein, 8 aa, Artificial Sequence
  Description of Artificial Sequence: Synthetic peptide
GYTFTSYW

SEQ ID NO: 2100 - protein, 8 aa, Artificial Sequence
  Description of Artificial Sequence: Synthetic peptide
IHPNSGST

SEQ ID NO: 2101 - protein, 12 aa, Artificial Sequence
  Description of Artificial Sequence: Synthetic peptide
ARCGYDGAWFAY

SEQ ID NO: 2102 - protein, 6 aa, Artificial Sequence
  Description of Artificial Sequence: Synthetic peptide
QGISNC

SEQ ID NO: 2103 - protein, 3 aa, Artificial Sequence
  Description of Artificial Sequence: Synthetic peptide
YTS

SEQ ID NO: 2104 - protein, 9 aa, Artificial Sequence
  Description of Artificial Sequence: Synthetic peptide
QQYSKVPYT

SEQ ID NO: 2105 - protein, 119 aa, Artificial Sequence
  Description of Artificial Sequence: Synthetic polypeptide
QVQLKESGPELVKPGASVKLSCKASGYTFTSYWMHWVKQRPGQGLEWIGMIHPNSGSTNYNEKFKSKATLTVDKSSSTAYMQLSSLTSEDSAVYYCARCGYDGAWFAYWGQGTSVTVSS

SEQ ID NO: 2106 - protein, 107 aa, Artificial Sequence
  Description of Artificial Sequence: Synthetic polypeptide
DIQMTQTTSSLSASLGDRVTISCSASQGISNCLNWYQQKPDGTVKLLIHYTSSLHSGVPSRFSGGGSGTHYSLTISNLEPEDIATYYCQQYSKVPYTFGSGTKLEIK

SEQ ID NO: 2107 - protein, 449 aa, Artificial Sequence
  Description of Artificial Sequence: Synthetic polypeptide
QVQLKESGPELVKPGASVKLSCKASGYTFTSYWMHWVKQRPGQGLEWIGMIHPNSGSTNYNEKFKSKATLTVDKSSSTAYMQLSSLTSEDSAVYYCARCGYDGAWFAYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2108 - protein, 214 aa, Artificial Sequence
  Description of Artificial Sequence: Synthetic polypeptide
DIQMTQTTSSLSASLGDRVTISCSASQGISNCLNWYQQKPDGTVKLLIHYTSSLHSGVPSRFSGGGSGTHYSLTISNLEPEDIATYYCQQYSKVPYTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2109 - protein, 5 aa, Artificial Sequence
  Description of Artificial Sequence: Synthetic peptide
NYWMQ

SEQ ID NO: 2110 - protein, 17 aa, Artificial Sequence
  Description of Artificial Sequence: Synthetic peptide
EIDPSDTFTNYNQNFKD

SEQ ID NO: 2111 - protein, 11 aa, Artificial Sequence
  Description of Artificial Sequence: Synthetic peptide
GDWDRDWYFDV

SEQ ID NO: 2112 - protein, 16 aa, Artificial Sequence
  Description of Artificial Sequence: Synthetic peptide
KSSQSLLYSDGKTYLN

SEQ ID NO: 2113 - protein, 7 aa, Artificial Sequence
  Description of Artificial Sequence: Synthetic peptide
LVSKLDS

SEQ ID NO: 2114 - protein, 9 aa, Artificial Sequence
  Description of Artificial Sequence: Synthetic peptide
LQATHFPHT

SEQ ID NO: 2115 - protein, 7 aa, Artificial Sequence
  Description of Artificial Sequence: Synthetic peptide
GYTFTNY

SEQ ID NO: 2116 - protein, 6 aa, Artificial Sequence
  Description of Artificial Sequence: Synthetic peptide
DPSDTF

SEQ ID NO: 2117 - protein, 10 aa, Artificial Sequence
  Description of Artificial Sequence: Synthetic peptide
GDWDRDWYFD

SEQ ID NO: 2118 - protein, 12 aa, Artificial Sequence
  Description of Artificial Sequence: Synthetic peptide
SQSLLYSDGKTY

SEQ ID NO: 2119 - protein, 3 aa, Artificial Sequence
  Description of Artificial Sequence: Synthetic peptide
LVS

SEQ ID NO: 2120 - protein, 6 aa, Artificial Sequence
  Description of Artificial Sequence: Synthetic peptide
ATHFPH

SEQ ID NO: 2121 - protein, 10 aa, Artificial Sequence
  Description of Artificial Sequence: Synthetic peptide
GYTFTNYWMQ

SEQ ID NO: 2122 - protein, 10 aa, Artificial Sequence
  Description of Artificial Sequence: Synthetic peptide
EIDPSDTFTN

SEQ ID NO: 2123 - protein, 11 aa, Artificial Sequence
  Description of Artificial Sequence: Synthetic peptide
GDWDRDWYFDV

SEQ ID NO: 2124 - protein, 16 aa, Artificial Sequence
  Description of Artificial Sequence: Synthetic peptide
KSSQSLLYSDGKTYLN

SEQ ID NO: 2125 - protein, 7 aa, Artificial Sequence
  Description of Artificial Sequence: Synthetic peptide
LVSKLDS

SEQ ID NO: 2126 - protein, 9 aa, Artificial Sequence
  Description of Artificial Sequence: Synthetic peptide
LQATHFPHT

SEQ ID NO: 2127 - protein, 6 aa, Artificial Sequence
  Description of Artificial Sequence: Synthetic peptide
TNYWMQ

SEQ ID NO: 2128 - protein, 13 aa, Artificial Sequence
  Description of Artificial Sequence: Synthetic peptide
WIGEIDPSDTFTN

SEQ ID NO: 2129 - protein, 12 aa, Artificial Sequence
  Description of Artificial Sequence: Synthetic peptide
ARGDWDRDWYFD

SEQ ID NO: 2130 - protein, 12 aa, Artificial Sequence
  Description of Artificial Sequence: Synthetic peptide
LYSDGKTYLNWL

SEQ ID NO: 2131 - protein, 10 aa, Artificial Sequence
  Description of Artificial Sequence: Synthetic peptide
LLIYLVSKLD

SEQ ID NO: 2132 - protein, 8 aa, Artificial Sequence
  Description of Artificial Sequence: Synthetic peptide
LQATHFPH

SEQ ID NO: 2133 - protein, 8 aa, Artificial Sequence
  Description of Artificial Sequence: Synthetic peptide
GYTFTNYW

SEQ ID NO: 2134 - protein, 8 aa, Artificial Sequence
  Description of Artificial Sequence: Synthetic peptide
IDPSDTFT

SEQ ID NO: 2135 - protein, 13 aa, Artificial Sequence
  Description of Artificial Sequence: Synthetic peptide
ARGDWDRDWYFDV

SEQ ID NO: 2136 - protein, 11 aa, Artificial Sequence
  Description of Artificial Sequence: Synthetic peptide
QSLLYSDGKTY

SEQ ID NO: 2137 - protein, 3 aa, Artificial Sequence
  Description of Artificial Sequence: Synthetic peptide
LVS

SEQ ID NO: 2138 - protein, 9 aa, Artificial Sequence
  Description of Artificial Sequence: Synthetic peptide
LQATHFPHT

SEQ ID NO: 2139 - protein, 120 aa, Artificial Sequence
  Description of Artificial Sequence: Synthetic polypeptide
QVQLQQPGAELVKPGASVRLSCKASGYTFTNYWMQWVQQRPGQGLEWIGEIDPSDTFTNYNQNFKDKATLTVDTSSSTAYLQLSSLTSEDSAVYYCARGDWDRDWYFDVWGTGTLVTVSA

SEQ ID NO: 2140 - protein, 112 aa, Artificial Sequence
  Description of Artificial Sequence: Synthetic polypeptide
DIVMTQTPLTLSVTIGQPASISCKSSQSLLYSDGKTYLNWLLQRPGESPKLLIYLVSKLDSGVPDRFTGSGSGTDFTLKISRVETEDLGIYYCLQATHFPHTFGAGTKLELK

SEQ ID NO: 2141 - protein, 450 aa, Artificial Sequence
  Description of Artificial Sequence: Synthetic polypeptide
QVQLQQPGAELVKPGASVRLSCKASGYTFTNYWMQWVQQRPGQGLEWIGEIDPSDTFTNYNQNFKDKATLTVDTSSSTAYLQLSSLTSEDSAVYYCARGDWDRDWYFDVWGTGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2142 - protein, 219 aa, Artificial Sequence
  Description of Artificial Sequence: Synthetic polypeptide
DIVMTQTPLTLSVTIGQPASISCKSSQSLLYSDGKTYLNWLLQRPGESPKLLIYLVSKLDSGVPDRFTGSGSGTDFTLKISRVETEDLGIYYCLQATHFPHTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2143 - protein, 5 aa, Artificial Sequence
  Description of Artificial Sequence: Synthetic peptide
DTYMH

SEQ ID NO: 2144 - protein, 17 aa, Artificial Sequence
  Description of Artificial Sequence: Synthetic peptide
RIDPANGHTKFDPKFQG

SEQ ID NO: 2145 - protein, 4 aa, Artificial Sequence
  Description of Artificial Sequence: Synthetic peptide
RFAY

SEQ ID NO: 2146 - protein, 11 aa, Artificial Sequence
  Description of Artificial Sequence: Synthetic peptide
RASHEISGYLS

SEQ ID NO: 2147 - protein, 7 aa, Artificial Sequence
  Description of Artificial Sequence: Synthetic peptide
AASTLDS

SEQ ID NO: 2148 - protein, 9 aa, Artificial Sequence
  Description of Artificial Sequence: Synthetic peptide
LQYSSYPYT

SEQ ID NO: 2149 - protein, 7 aa, Artificial Sequence
  Description of Artificial Sequence: Synthetic peptide
GFNIKDT

SEQ ID NO: 2150 - protein, 6 aa, Artificial Sequence
  Description of Artificial Sequence: Synthetic peptide
DPANGH

SEQ ID NO: 2151 - protein, 3 aa, Artificial Sequence
  Description of Artificial Sequence: Synthetic peptide
RFA

SEQ ID NO: 2152 - protein, 7 aa, Artificial Sequence
  Description of Artificial Sequence: Synthetic peptide
SHEISGY

SEQ ID NO: 2153 - protein, 3 aa, Artificial Sequence
  Description of Artificial Sequence: Synthetic peptide
AAS

SEQ ID NO: 2154 - protein, 6 aa, Artificial Sequence
  Description of Artificial Sequence: Synthetic peptide
YSSYPY

SEQ ID NO: 2155 - protein, 10 aa, Artificial Sequence
  Description of Artificial Sequence: Synthetic peptide
GFNIKDTYMH

SEQ ID NO: 2156 - protein, 10 aa, Artificial Sequence
  Description of Artificial Sequence: Synthetic peptide
RIDPANGHTK

SEQ ID NO: 2157 - protein, 4 aa, Artificial Sequence
  Description of Artificial Sequence: Synthetic peptide
RFAY

SEQ ID NO: 2158 - protein, 11 aa, Artificial Sequence
  Description of Artificial Sequence: Synthetic peptide
RASHEISGYLS

SEQ ID NO: 2159 - protein, 7 aa, Artificial Sequence
  Description of Artificial Sequence: Synthetic peptide
AASTLDS

SEQ ID NO: 2160 - protein, 9 aa, Artificial Sequence
  Description of Artificial Sequence: Synthetic peptide
LQYSSYPYT

SEQ ID NO: 2161 - protein, 6 aa, Artificial Sequence
  Description of Artificial Sequence: Synthetic peptide
KDTYMH

SEQ ID NO: 2162 - protein, 13 aa, Artificial Sequence
  Description of Artificial Sequence: Synthetic peptide
WIGRIDPANGHTK

SEQ ID NO: 2163 - protein, 5 aa, Artificial Sequence
  Description of Artificial Sequence: Synthetic peptide
AIRFA

SEQ ID NO: 2164 - protein, 7 aa, Artificial Sequence
  Description of Artificial Sequence: Synthetic peptide
SGYLSWL

SEQ ID NO: 2165 - protein, 10 aa, Artificial Sequence
  Description of Artificial Sequence: Synthetic peptide
RLIYAASTLD

SEQ ID NO: 2166 - protein, 8 aa, Artificial Sequence
  Description of Artificial Sequence: Synthetic peptide
LQYSSYPY

SEQ ID NO: 2167 - protein, 8 aa, Artificial Sequence
  Description of Artificial Sequence: Synthetic peptide
GFNIKDTY

SEQ ID NO: 2168 - protein, 8 aa, Artificial Sequence
  Description of Artificial Sequence: Synthetic peptide
IDPANGHT

SEQ ID NO: 2169 - protein, 6 aa, Artificial Sequence
  Description of Artificial Sequence: Synthetic peptide
AIRFAY

SEQ ID NO: 2170 - protein, 6 aa, Artificial Sequence
  Description of Artificial Sequence: Synthetic peptide
HEISGY

SEQ ID NO: 2171 - protein, 3 aa, Artificial Sequence
  Description of Artificial Sequence: Synthetic peptide
AAS

SEQ ID NO: 2172 - protein, 9 aa, Artificial Sequence
  Description of Artificial Sequence: Synthetic peptide
LQYSSYPYT

SEQ ID NO: 2173 - protein, 113 aa, Artificial Sequence
  Description of Artificial Sequence: Synthetic polypeptide
EVKLVESGAELVKPGASVKLSCTASGFNIKDTYMHWVKQRPEQGLEWIGRIDPANGHTKFDPKFQGKATITADTSSNTAYLQLSSLTSEDTAVYYCAIRFAYWGQGTLVTVSA

SEQ ID NO: 2174 - protein, 107 aa, Artificial Sequence
  Description of Artificial Sequence: Synthetic polypeptide
DIQMTQSPSSLSASLGDRVSLTCRASHEISGYLSWLQQKPDGTFKRLIYAASTLDSGVPKRFSGSRSGSDYSLSISSLESEDFADYYCLQYSSYPYTFGSGTKLEMK

SEQ ID NO: 2175 - protein, 443 aa, Artificial Sequence
  Description of Artificial Sequence: Synthetic polypeptide
EVKLVESGAELVKPGASVKLSCTASGFNIKDTYMHWVKQRPEQGLEWIGRIDPANGHTKFDPKFQGKATITADTSSNTAYLQLSSLTSEDTAVYYCAIRFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2176 - protein, 214 aa, Artificial Sequence
  Description of Artificial Sequence: Synthetic polypeptide
DIQMTQSPSSLSASLGDRVSLTCRASHEISGYLSWLQQKPDGTFKRLIYAASTLDSGVPKRFSGSRSGSDYSLSISSLESEDFADYYCLQYSSYPYTFGSGTKLEMKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2177 - protein, 5 aa, Artificial Sequence
  Description of Artificial Sequence: Synthetic peptide
SYWMS

SEQ ID NO: 2178 - protein, 17 aa, Artificial Sequence
  Description of Artificial Sequence: Synthetic peptide
NINEDGNEKYYVDSVKG

SEQ ID NO: 2179 - protein, 10 aa, Artificial Sequence
  Description of Artificial Sequence: Synthetic peptide
EGGQWLSLDY

SEQ ID NO: 2180 - protein, 11 aa, Artificial Sequence
  Description of Artificial Sequence: Synthetic peptide
RASQGISSWLA

SEQ ID NO: 2181 - protein, 7 aa, Artificial Sequence
  Description of Artificial Sequence: Synthetic peptide
GASSLQS

SEQ ID NO: 2182 - protein, 9 aa, Artificial Sequence
  Description of Artificial Sequence: Synthetic peptide
QQANSFPWT

SEQ ID NO: 2183 - protein, 7 aa, Artificial Sequence
  Description of Artificial Sequence: Synthetic peptide
GFTFSSY

SEQ ID NO: 2184 - protein, 6 aa, Artificial Sequence
  Description of Artificial Sequence: Synthetic peptide
NEDGNE

SEQ ID NO: 2185 - protein, 9 aa, Artificial Sequence
  Description of Artificial Sequence: Synthetic peptide
EGGQWLSLD

SEQ ID NO: 2186 - protein, 7 aa, Artificial Sequence
  Description of Artificial Sequence: Synthetic peptide
SQGISSW

SEQ ID NO: 2187 - protein, 3 aa, Artificial Sequence
  Description of Artificial Sequence: Synthetic peptide
GAS

SEQ ID NO: 2188 - protein, 6 aa, Artificial Sequence
  Description of Artificial Sequence: Synthetic peptide
ANSFPW

SEQ ID NO: 2189 - protein, 10 aa, Artificial Sequence
  Description of Artificial Sequence: Synthetic peptide
GFTFSSYWMS

SEQ ID NO: 2190 - protein, 10 aa, Artificial Sequence
  Description of Artificial Sequence: Synthetic peptide
NINEDGNEKY

SEQ ID NO: 2191 - protein, 10 aa, Artificial Sequence
  Description of Artificial Sequence: Synthetic peptide
EGGQWLSLDY

SEQ ID NO: 2192 - protein, 11 aa, Artificial Sequence
  Description of Artificial Sequence: Synthetic peptide
RASQGISSWLA

SEQ ID NO: 2193 - protein, 7 aa, Artificial Sequence
  Description of Artificial Sequence: Synthetic peptide
GASSLQS

SEQ ID NO: 2194 - protein, 9 aa, Artificial Sequence
  Description of Artificial Sequence: Synthetic peptide
QQANSFPWT

SEQ ID NO: 2195 - protein, 6 aa, Artificial Sequence
  Description of Artificial Sequence: Synthetic peptide
SSYWMS

SEQ ID NO: 2196 - protein, 13 aa, Artificial Sequence
  Description of Artificial Sequence: Synthetic peptide
WVANINEDGNEKY

SEQ ID NO: 2197 - protein, 11 aa, Artificial Sequence
  Description of Artificial Sequence: Synthetic peptide
AREGGQWLSLD

SEQ ID NO: 2198 - protein, 7 aa, Artificial Sequence
  Description of Artificial Sequence: Synthetic peptide
SSWLAWY

SEQ ID NO: 2199 - protein, 10 aa, Artificial Sequence
  Description of Artificial Sequence: Synthetic peptide
ILIYGASSLQ

SEQ ID NO: 2200 - protein, 8 aa, Artificial Sequence
  Description of Artificial Sequence: Synthetic peptide
QQANSFPW

SEQ ID NO: 2201 - protein, 8 aa, Artificial Sequence
  Description of Artificial Sequence: Synthetic peptide
GFTFSSYW

SEQ ID NO: 2202 - protein, 8 aa, Artificial Sequence
  Description of Artificial Sequence: Synthetic peptide
INEDGNEK

SEQ ID NO: 2203 - protein, 12 aa, Artificial Sequence
  Description of Artificial Sequence: Synthetic peptide
AREGGQWLSLDY

SEQ ID NO: 2204 - protein, 6 aa, Artificial Sequence
  Description of Artificial Sequence: Synthetic peptide
QGISSW

SEQ ID NO: 2205 - protein, 3 aa, Artificial Sequence
  Description of Artificial Sequence: Synthetic peptide
GAS

SEQ ID NO: 2206 - protein, 9 aa, Artificial Sequence
  Description of Artificial Sequence: Synthetic peptide
QQANSFPWT

SEQ ID NO: 2207 - protein, 119 aa, Artificial Sequence
  Description of Artificial Sequence: Synthetic polypeptide
EVQLVESGGGLVQPGGSLRLSCAASGFTFSSYWMSWVRQAPGKGLEWVANINEDGNEKYYVDSVKGRLTISRDNAKNSLYLQMNSLRAEDTAVYFCAREGGQWLSLDYWGQGALVTVSS

SEQ ID NO: 2208 - protein, 107 aa, Artificial Sequence
  Description of Artificial Sequence: Synthetic polypeptide
DIQMTQSPSSVSASVGDRVSITCRASQGISSWLAWYQQKPGKAPKILIYGASSLQSGVPSRFSGSGSGTDFTLTISSLQPEDFATYYCQQANSFPWTFGQGTKVEIK

SEQ ID NO: 2209-2210 - skipped (2 entries)

SEQ ID NO: 2211 - protein, 5 aa, Artificial Sequence
  Description of Artificial Sequence: Synthetic peptide
NYYWS

SEQ ID NO: 2212 - protein, 16 aa, Artificial Sequence
  Description of Artificial Sequence: Synthetic peptide
RIYSSGSTNYKSSLKS

SEQ ID NO: 2213 - protein, 12 aa, Artificial Sequence
  Description of Artificial Sequence: Synthetic peptide
EREAYLYYGLDV

SEQ ID NO: 2214 - protein, 11 aa, Artificial Sequence
  Description of Artificial Sequence: Synthetic peptide
QASQDIGNYLN

SEQ ID NO: 2215 - protein, 7 aa, Artificial Sequence
  Description of Artificial Sequence: Synthetic peptide
DASNLET

SEQ ID NO: 2216 - protein, 9 aa, Artificial Sequence
  Description of Artificial Sequence: Synthetic peptide
QQYDSLPLT

SEQ ID NO: 2217 - protein, 7 aa, Artificial Sequence
  Description of Artificial Sequence: Synthetic peptide
GGSIINY

SEQ ID NO: 2218 - protein, 5 aa, Artificial Sequence
  Description of Artificial Sequence: Synthetic peptide
YSSGS

SEQ ID NO: 2219 - protein, 11 aa, Artificial Sequence
  Description of Artificial Sequence: Synthetic peptide
EREAYLYYGLD

SEQ ID NO: 2220 - protein, 7 aa, Artificial Sequence
  Description of Artificial Sequence: Synthetic peptide
SQDIGNY

SEQ ID NO: 2221 - protein, 3 aa, Artificial Sequence
  Description of Artificial Sequence: Synthetic peptide
DAS

SEQ ID NO: 2222 - protein, 6 aa, Artificial Sequence
  Description of Artificial Sequence: Synthetic peptide
YDSLPL

SEQ ID NO: 2223 - protein, 10 aa, Artificial Sequence
  Description of Artificial Sequence: Synthetic peptide
GGSIINYYWS

SEQ ID NO: 2224 - protein, 9 aa, Artificial Sequence
  Description of Artificial Sequence: Synthetic peptide
RIYSSGSTN

SEQ ID NO: 2225 - protein, 12 aa, Artificial Sequence
  Description of Artificial Sequence: Synthetic peptide
EREAYLYYGLDV

SEQ ID NO: 2226 - protein, 11 aa, Artificial Sequence
  Description of Artificial Sequence: Synthetic peptide
QASQDIGNYLN

SEQ ID NO: 2227 - protein, 7 aa, Artificial Sequence
  Description of Artificial Sequence: Synthetic peptide
DASNLET

SEQ ID NO: 2228 - protein, 9 aa, Artificial Sequence
  Description of Artificial Sequence: Synthetic peptide
QQYDSLPLT

SEQ ID NO: 2229 - protein, 6 aa, Artificial Sequence
  Description of Artificial Sequence: Synthetic peptide
INYYWS

SEQ ID NO: 2230 - protein, 12 aa, Artificial Sequence
  Description of Artificial Sequence: Synthetic peptide
WIGRIYSSGSTN

SEQ ID NO: 2231 - protein, 13 aa, Artificial Sequence
  Description of Artificial Sequence: Synthetic peptide
AREREAYLYYGLD

SEQ ID NO: 2232 - protein, 7 aa, Artificial Sequence
  Description of Artificial Sequence: Synthetic peptide
GNYLNWY

SEQ ID NO: 2233 - protein, 10 aa, Artificial Sequence
  Description of Artificial Sequence: Synthetic peptide
LLIYDASNLE

SEQ ID NO: 2234 - protein, 8 aa, Artificial Sequence
  Description of Artificial Sequence: Synthetic peptide
QQYDSLPL

SEQ ID NO: 2235 - protein, 8 aa, Artificial Sequence
  Description of Artificial Sequence: Synthetic peptide
GGSIINYY

SEQ ID NO: 2236 - protein, 7 aa, Artificial Sequence
  Description of Artificial Sequence: Synthetic peptide
IYSSGST

SEQ ID NO: 2237 - protein, 14 aa, Artificial Sequence
  Description of Artificial Sequence: Synthetic peptide
AREREAYLYYGLDV

SEQ ID NO: 2238 - protein, 6 aa, Artificial Sequence
  Description of Artificial Sequence: Synthetic peptide
QDIGNY

SEQ ID NO: 2239 - protein, 3 aa, Artificial Sequence
  Description of Artificial Sequence: Synthetic peptide
DAS

SEQ ID NO: 2240 - protein, 9 aa, Artificial Sequence
  Description of Artificial Sequence: Synthetic peptide
QQYDSLPLT

SEQ ID NO: 2241 - protein, 120 aa, Artificial Sequence
  Description of Artificial Sequence: Synthetic polypeptide
QVQLQESGPGLVKPSETLSLTCTVSGGSIINYYWSWIRQPAGKGLEWIGRIYSSGSTNYKSSLKSRVTMSVDTSKNQFYLKLRSVTAADTAVYYCAREREAYLYYGLDVWGQGTTVTVSS

SEQ ID NO: 2242 - protein, 107 aa, Artificial Sequence
  Description of Artificial Sequence: Synthetic polypeptide
DIQMTQSPSSLSASVGDRVTITCQASQDIGNYLNWYQQKPGKAPKLLIYDASNLETGVPSRFSGSGSGTDFTFTISSLQPEDLATYYCQQYDSLPLTFGGGTKVEIK

SEQ ID NO: 2243-2244 - skipped (2 entries)

SEQ ID NO: 2245 - protein, 5 aa, Artificial Sequence
  Description of Artificial Sequence: Synthetic peptide
SNYMN

SEQ ID NO: 2246 - protein, 16 aa, Artificial Sequence
  Description of Artificial Sequence: Synthetic peptide
VIYAGDNTYSADSVKG

SEQ ID NO: 2247 - protein, 10 aa, Artificial Sequence
  Description of Artificial Sequence: Synthetic peptide
EGGTTGAFDI

SEQ ID NO: 2248 - protein, 11 aa, Artificial Sequence
  Description of Artificial Sequence: Synthetic peptide
RASQGINSWLA

SEQ ID NO: 2249 - protein, 7 aa, Artificial Sequence
  Description of Artificial Sequence: Synthetic peptide
AASSLQS

SEQ ID NO: 2250 - protein, 9 aa, Artificial Sequence
  Description of Artificial Sequence: Synthetic peptide
QQGNSFPYT

SEQ ID NO: 2251 - protein, 7 aa, Artificial Sequence
  Description of Artificial Sequence: Synthetic peptide
GFTVSSN

SEQ ID NO: 2252 - protein, 5 aa, Artificial Sequence
  Description of Artificial Sequence: Synthetic peptide
YAGDN

SEQ ID NO: 2253 - protein, 9 aa, Artificial Sequence
  Description of Artificial Sequence: Synthetic peptide
EGGTTGAFD

SEQ ID NO: 2254 - protein, 7 aa, Artificial Sequence
  Description of Artificial Sequence: Synthetic peptide
SQGINSW

SEQ ID NO: 2255 - protein, 3 aa, Artificial Sequence
  Description of Artificial Sequence: Synthetic peptide
AAS

SEQ ID NO: 2256 - protein, 6 aa, Artificial Sequence
  Description of Artificial Sequence: Synthetic peptide
GNSFPY

SEQ ID NO: 2257 - protein, 10 aa, Artificial Sequence
  Description of Artificial Sequence: Synthetic peptide
GFTVSSNYMN

SEQ ID NO: 2258 - protein, 9 aa, Artificial Sequence
  Description of Artificial Sequence: Synthetic peptide
VIYAGDNTY

SEQ ID NO: 2259 - protein, 10 aa, Artificial Sequence
  Description of Artificial Sequence: Synthetic peptide
EGGTTGAFDI

SEQ ID NO: 2260 - protein, 11 aa, Artificial Sequence
  Description of Artificial Sequence: Synthetic peptide
RASQGINSWLA

SEQ ID NO: 2261 - protein, 7 aa, Artificial Sequence
  Description of Artificial Sequence: Synthetic peptide
AASSLQS

SEQ ID NO: 2262 - protein, 9 aa, Artificial Sequence
  Description of Artificial Sequence: Synthetic peptide
QQGNSFPYT

SEQ ID NO: 2263 - protein, 6 aa, Artificial Sequence
  Description of Artificial Sequence: Synthetic peptide
SSNYMN

SEQ ID NO: 2264 - protein, 12 aa, Artificial Sequence
  Description of Artificial Sequence: Synthetic peptide
WVSVIYAGDNTY

SEQ ID NO: 2265 - protein, 11 aa, Artificial Sequence
  Description of Artificial Sequence: Synthetic peptide
AREGGTTGAFD

SEQ ID NO: 2266 - protein, 7 aa, Artificial Sequence
  Description of Artificial Sequence: Synthetic peptide
NSWLAWY

SEQ ID NO: 2267 - protein, 10 aa, Artificial Sequence
  Description of Artificial Sequence: Synthetic peptide
LLIYAASSLQ

SEQ ID NO: 2268 - protein, 8 aa, Artificial Sequence
  Description of Artificial Sequence: Synthetic peptide
QQGNSFPY

SEQ ID NO: 2269 - protein, 8 aa, Artificial Sequence
  Description of Artificial Sequence: Synthetic peptide
GFTVSSNY

SEQ ID NO: 2270 - protein, 7 aa, Artificial Sequence
  Description of Artificial Sequence: Synthetic peptide
IYAGDNT

SEQ ID NO: 2271 - protein, 12 aa, Artificial Sequence
  Description of Artificial Sequence: Synthetic peptide
AREGGTTGAFDI

SEQ ID NO: 2272 - protein, 6 aa, Artificial Sequence
  Description of Artificial Sequence: Synthetic peptide
QGINSW

SEQ ID NO: 2273 - protein, 3 aa, Artificial Sequence
  Description of Artificial Sequence: Synthetic peptide
AAS

SEQ ID NO: 2274 - protein, 9 aa, Artificial Sequence
  Description of Artificial Sequence: Synthetic peptide
QQGNSFPYT

SEQ ID NO: 2275 - protein, 118 aa, Artificial Sequence
  Description of Artificial Sequence: Synthetic polypeptide
EVQLVESGGGLIQPGGSLRLSCAASGFTVSSNYMNWVRQAPGKGLEWVSVIYAGDNTYSADSVKGRFTISRDNSNNTLCLQMNSLRAEDTAVYYCAREGGTTGAFDIWGQGTMVTVSS

SEQ ID NO: 2276 - protein, 107 aa, Artificial Sequence
  Description of Artificial Sequence: Synthetic polypeptide
DIQMTQSPSSVSASVGDRVTITCRASQGINSWLAWYQQKPGKAPKLLIYAASSLQSGVPSRFSGSGSGTDFTLTISSLQPEDFATYYCQQGNSFPYTFGQGTKLEIK

SEQ ID NO: 2277-2278 - skipped (2 entries)

SEQ ID NO: 2279 - protein, 5 aa, Artificial Sequence
  Description of Artificial Sequence: Synthetic peptide
GYYWS

SEQ ID NO: 2280 - protein, 16 aa, Artificial Sequence
  Description of Artificial Sequence: Synthetic peptide
EINHSGSTNYNPSLKS

SEQ ID NO: 2281 - protein, 7 aa, Artificial Sequence
  Description of Artificial Sequence: Synthetic peptide
LVNWFDP

SEQ ID NO: 2282 - protein, 11 aa, Artificial Sequence
  Description of Artificial Sequence: Synthetic peptide
RASQDISNWLA

SEQ ID NO: 2283 - protein, 7 aa, Artificial Sequence
  Description of Artificial Sequence: Synthetic peptide
AASSLQT

SEQ ID NO: 2284 - protein, 9 aa, Artificial Sequence
  Description of Artificial Sequence: Synthetic peptide
QQANSFPYS

SEQ ID NO: 2285 - protein, 7 aa, Artificial Sequence
  Description of Artificial Sequence: Synthetic peptide
GGSFSGY

SEQ ID NO: 2286 - protein, 5 aa, Artificial Sequence
  Description of Artificial Sequence: Synthetic peptide
NHSGS

SEQ ID NO: 2287 - protein, 6 aa, Artificial Sequence
  Description of Artificial Sequence: Synthetic peptide
LVNWFD

SEQ ID NO: 2288 - protein, 7 aa, Artificial Sequence
  Description of Artificial Sequence: Synthetic peptide
SQDISNW

SEQ ID NO: 2289 - protein, 3 aa, Artificial Sequence
  Description of Artificial Sequence: Synthetic peptide
AAS

SEQ ID NO: 2290 - protein, 6 aa, Artificial Sequence
  Description of Artificial Sequence: Synthetic peptide
ANSFPY

SEQ ID NO: 2291 - protein, 10 aa, Artificial Sequence
  Description of Artificial Sequence: Synthetic peptide
GGSFSGYYWS

SEQ ID NO: 2292 - protein, 9 aa, Artificial Sequence
  Description of Artificial Sequence: Synthetic peptide
EINHSGSTN

SEQ ID NO: 2293 - protein, 7 aa, Artificial Sequence
  Description of Artificial Sequence: Synthetic peptide
LVNWFDP

SEQ ID NO: 2294 - protein, 11 aa, Artificial Sequence
  Description of Artificial Sequence: Synthetic peptide
RASQDISNWLA

SEQ ID NO: 2295 - protein, 7 aa, Artificial Sequence
  Description of Artificial Sequence: Synthetic peptide
AASSLQT

SEQ ID NO: 2296 - protein, 9 aa, Artificial Sequence
  Description of Artificial Sequence: Synthetic peptide
QQANSFPYS

SEQ ID NO: 2297 - protein, 6 aa, Artificial Sequence
  Description of Artificial Sequence: Synthetic peptide
SGYYWS

SEQ ID NO: 2298 - protein, 12 aa, Artificial Sequence
  Description of Artificial Sequence: Synthetic peptide
WIGEINHSGSTN

SEQ ID NO: 2299 - protein, 8 aa, Artificial Sequence
  Description of Artificial Sequence: Synthetic peptide
ARLVNWFD

SEQ ID NO: 2300 - protein, 7 aa, Artificial Sequence
  Description of Artificial Sequence: Synthetic peptide
SNWLAWY

SEQ ID NO: 2301 - protein, 10 aa, Artificial Sequence
  Description of Artificial Sequence: Synthetic peptide
LLIFAASSLQ

SEQ ID NO: 2302 - protein, 8 aa, Artificial Sequence
  Description of Artificial Sequence: Synthetic peptide
QQANSFPY

SEQ ID NO: 2303 - protein, 8 aa, Artificial Sequence
  Description of Artificial Sequence: Synthetic peptide
GGSFSGYY

SEQ ID NO: 2304 - protein, 7 aa, Artificial Sequence
  Description of Artificial Sequence: Synthetic peptide
INHSGST

SEQ ID NO: 2305 - protein, 9 aa, Artificial Sequence
  Description of Artificial Sequence: Synthetic peptide
ARLVNWFDP

SEQ ID NO: 2306 - protein, 6 aa, Artificial Sequence
  Description of Artificial Sequence: Synthetic peptide
QDISNW

SEQ ID NO: 2307 - protein, 3 aa, Artificial Sequence
  Description of Artificial Sequence: Synthetic peptide
AAS

SEQ ID NO: 2308 - protein, 9 aa, Artificial Sequence
  Description of Artificial Sequence: Synthetic peptide
QQANSFPYS

SEQ ID NO: 2309 - protein, 115 aa, Artificial Sequence
  Description of Artificial Sequence: Synthetic polypeptide
QVQLQQWGAGLLKPSETLSLTCAVYGGSFSGYYWSWIRQPPGKGLEWIGEINHSGSTNYNPSLKSRVTISVDTSENQFSLKLNSVTAADTAVYYCARLVNWFDPWGQGTLVTVSS

SEQ ID NO: 2310 - protein, 107 aa, Artificial Sequence
  Description of Artificial Sequence: Synthetic polypeptide
EIQMTQSPSSVSASVGDRVTITCRASQDISNWLAWYQQKPGKAPNLLIFAASSLQTGVPSRFSGSGSGTDFTLTISSLQPDDFATYYCQQANSFPYSFGQGTNLGIK

SEQ ID NO: 2311 - protein, 445 aa, Artificial Sequence
  Description of Artificial Sequence: Synthetic peptide
QVQLQQWGAGLLKPSETLSLTCAVYGGSFSGYYWSWIRQPPGKGLEWIGEINHSGSTNYNPSLKSRVTISVDTSENQFSLKLNSVTAADTAVYYCARLVNWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2312 - protein, 214 aa, Artificial Sequence
  Description of Artificial Sequence: Synthetic peptide
EIQMTQSPSSVSASVGDRVTITCRASQDISNWLAWYQQKPGKAPNLLIFAASSLQTGVPSRFSGSGSGTDFTLTISSLQPDDFATYYCQQANSFPYSFGQGTNLGIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2313 - protein, 5 aa, Artificial Sequence
  Description of Artificial Sequence: Synthetic peptide
NYDMH

SEQ ID NO: 2314 - protein, 16 aa, Artificial Sequence
  Description of Artificial Sequence: Synthetic peptide
TIGTAGDTYYPASVKG

SEQ ID NO: 2315 - protein, 10 aa, Artificial Sequence
  Description of Artificial Sequence: Synthetic peptide
GGDYYYGMDV

SEQ ID NO: 2316 - protein, 12 aa, Artificial Sequence
  Description of Artificial Sequence: Synthetic peptide
RASQSVSSSYLA

SEQ ID NO: 2317 - protein, 7 aa, Artificial Sequence
  Description of Artificial Sequence: Synthetic peptide
GASSRAT

SEQ ID NO: 2318 - protein, 9 aa, Artificial Sequence
  Description of Artificial Sequence: Synthetic peptide
QQFGSSPFT

SEQ ID NO: 2319 - protein, 7 aa, Artificial Sequence
  Description of Artificial Sequence: Synthetic peptide
GFTFNNY

SEQ ID NO: 2320 - protein, 5 aa, Artificial Sequence
  Description of Artificial Sequence: Synthetic peptide
GTAGD

SEQ ID NO: 2321 - protein, 9 aa, Artificial Sequence
  Description of Artificial Sequence: Synthetic peptide
GGDYYYGMD

SEQ ID NO: 2322 - protein, 8 aa, Artificial Sequence
  Description of Artificial Sequence: Synthetic peptide
SQSVSSSY

SEQ ID NO: 2323 - protein, 3 aa, Artificial Sequence
  Description of Artificial Sequence: Synthetic peptide
GAS

SEQ ID NO: 2324 - protein, 6 aa, Artificial Sequence
  Description of Artificial Sequence: Synthetic peptide
FGSSPF

SEQ ID NO: 2325 - protein, 10 aa, Artificial Sequence
  Description of Artificial Sequence: Synthetic peptide
GFTFNNYDMH

SEQ ID NO: 2326 - protein, 9 aa, Artificial Sequence
  Description of Artificial Sequence: Synthetic peptide
TIGTAGDTY

SEQ ID NO: 2327 - protein, 10 aa, Artificial Sequence
  Description of Artificial Sequence: Synthetic peptide
GGDYYYGMDV

SEQ ID NO: 2328 - protein, 12 aa, Artificial Sequence
  Description of Artificial Sequence: Synthetic peptide
RASQSVSSSYLA

SEQ ID NO: 2329 - protein, 7 aa, Artificial Sequence
  Description of Artificial Sequence: Synthetic peptide
GASSRAT

SEQ ID NO: 2330 - protein, 9 aa, Artificial Sequence
  Description of Artificial Sequence: Synthetic peptide
QQFGSSPFT

SEQ ID NO: 2331 - protein, 6 aa, Artificial Sequence
  Description of Artificial Sequence: Synthetic peptide
NNYDMH

SEQ ID NO: 2332 - protein, 12 aa, Artificial Sequence
  Description of Artificial Sequence: Synthetic peptide
WVSTIGTAGDTY

SEQ ID NO: 2333 - protein, 11 aa, Artificial Sequence
  Description of Artificial Sequence: Synthetic peptide
ARGGDYYYGMD

SEQ ID NO: 2334 - protein, 8 aa, Artificial Sequence
  Description of Artificial Sequence: Synthetic peptide
SSSYLAWY

SEQ ID NO: 2335 - protein, 10 aa, Artificial Sequence
  Description of Artificial Sequence: Synthetic peptide
LLIYGASSRA

SEQ ID NO: 2336 - protein, 8 aa, Artificial Sequence
  Description of Artificial Sequence: Synthetic peptide
QQFGSSPF

SEQ ID NO: 2337 - protein, 8 aa, Artificial Sequence
  Description of Artificial Sequence: Synthetic peptide
GFTFNNYD

SEQ ID NO: 2338 - protein, 7 aa, Artificial Sequence
  Description of Artificial Sequence: Synthetic peptide
IGTAGDT

SEQ ID NO: 2339 - protein, 12 aa, Artificial Sequence
  Description of Artificial Sequence: Synthetic peptide
ARGGDYYYGMDV

SEQ ID NO: 2340 - protein, 7 aa, Artificial Sequence
  Description of Artificial Sequence: Synthetic peptide
QSVSSSY

SEQ ID NO: 2341 - protein, 3 aa, Artificial Sequence
  Description of Artificial Sequence: Synthetic peptide
GAS

SEQ ID NO: 2342 - protein, 9 aa, Artificial Sequence
  Description of Artificial Sequence: Synthetic peptide
QQFGSSPFT

SEQ ID NO: 2343 - protein, 118 aa, Artificial Sequence
  Description of Artificial Sequence: Synthetic polypeptide
EVQLVESGGGLVQPGGSLRLSCAASGFTFNNYDMHWVRQATGKGLEWVSTIGTAGDTYYPASVKGRFTIYRENAKNSLYLQMNSLRAGDTAVYYCARGGDYYYGMDVWGQGTTVTVSS

SEQ ID NO: 2344 - protein, 108 aa, Artificial Sequence
  Description of Artificial Sequence: Synthetic polypeptide
EIVLTQSPGTLCLSPGERATLSCRASQSVSSSYLAWYQQKPGQAPRLLIYGASSRATGIPDRFSGSGSGTDFTLTISRLEPEDFAVYYCQQFGSSPFTFGPGTKVDIK

SEQ ID NO: 2345-2346 - skipped (2 entries)

SEQ ID NO: 2347 - protein, 5 aa, Artificial Sequence
  Description of Artificial Sequence: Synthetic peptide
SYDMH

SEQ ID NO: 2348 - protein, 16 aa, Artificial Sequence
  Description of Artificial Sequence: Synthetic peptide
TIGTAGDTYYPGSVKG

SEQ ID NO: 2349 - protein, 10 aa, Artificial Sequence
  Description of Artificial Sequence: Synthetic peptide
GGDYYYGMDV

SEQ ID NO: 2350 - protein, 12 aa, Artificial Sequence
  Description of Artificial Sequence: Synthetic peptide
RASQNTYSSYLA

SEQ ID NO: 2351 - protein, 7 aa, Artificial Sequence
  Description of Artificial Sequence: Synthetic peptide
GASNRAT

SEQ ID NO: 2352 - protein, 9 aa, Artificial Sequence
  Description of Artificial Sequence: Synthetic peptide
QQHGTSPFT

SEQ ID NO: 2353 - protein, 7 aa, Artificial Sequence
  Description of Artificial Sequence: Synthetic peptide
GFTFSSY

SEQ ID NO: 2354 - protein, 5 aa, Artificial Sequence
  Description of Artificial Sequence: Synthetic peptide
GTAGD

SEQ ID NO: 2355 - protein, 9 aa, Artificial Sequence
  Description of Artificial Sequence: Synthetic peptide
GGDYYYGMD

SEQ ID NO: 2356 - protein, 8 aa, Artificial Sequence
  Description of Artificial Sequence: Synthetic peptide
SQNTYSSY

SEQ ID NO: 2357 - protein, 3 aa, Artificial Sequence
  Description of Artificial Sequence: Synthetic peptide
GAS

SEQ ID NO: 2358 - protein, 6 aa, Artificial Sequence
  Description of Artificial Sequence: Synthetic peptide
HGTSPF

SEQ ID NO: 2359 - protein, 10 aa, Artificial Sequence
  Description of Artificial Sequence: Synthetic peptide
GFTFSSYDMH

SEQ ID NO: 2360 - protein, 9 aa, Artificial Sequence
  Description of Artificial Sequence: Synthetic peptide
TIGTAGDTY

SEQ ID NO: 2361 - protein, 10 aa, Artificial Sequence
  Description of Artificial Sequence: Synthetic peptide
GGDYYYGMDV

SEQ ID NO: 2362 - protein, 12 aa, Artificial Sequence
  Description of Artificial Sequence: Synthetic peptide
RASQNTYSSYLA

SEQ ID NO: 2363 - protein, 7 aa, Artificial Sequence
  Description of Artificial Sequence: Synthetic peptide
GASNRAT

SEQ ID NO: 2364 - protein, 9 aa, Artificial Sequence
  Description of Artificial Sequence: Synthetic peptide
QQHGTSPFT

SEQ ID NO: 2365 - protein, 6 aa, Artificial Sequence
  Description of Artificial Sequence: Synthetic peptide
SSYDMH

SEQ ID NO: 2366 - protein, 12 aa, Artificial Sequence
  Description of Artificial Sequence: Synthetic peptide
WVSTIGTAGDTY

SEQ ID NO: 2367 - protein, 11 aa, Artificial Sequence
  Description of Artificial Sequence: Synthetic peptide
ARGGDYYYGMD

SEQ ID NO: 2368 - protein, 8 aa, Artificial Sequence
  Description of Artificial Sequence: Synthetic peptide
YSSYLAWY

SEQ ID NO: 2369 - protein, 10 aa, Artificial Sequence
  Description of Artificial Sequence: Synthetic peptide
LLIYGASNRA

SEQ ID NO: 2370 - protein, 8 aa, Artificial Sequence
  Description of Artificial Sequence: Synthetic peptide
QQHGTSPF

SEQ ID NO: 2371 - protein, 8 aa, Artificial Sequence
  Description of Artificial Sequence: Synthetic peptide
GFTFSSYD

SEQ ID NO: 2372 - protein, 7 aa, Artificial Sequence
  Description of Artificial Sequence: Synthetic peptide
IGTAGDT

SEQ ID NO: 2373 - protein, 12 aa, Artificial Sequence
  Description of Artificial Sequence: Synthetic peptide
ARGGDYYYGMDV

SEQ ID NO: 2374 - protein, 7 aa, Artificial Sequence
  Description of Artificial Sequence: Synthetic peptide
QNTYSSY

SEQ ID NO: 2375 - protein, 3 aa, Artificial Sequence
  Description of Artificial Sequence: Synthetic peptide
GAS

SEQ ID NO: 2376 - protein, 9 aa, Artificial Sequence
  Description of Artificial Sequence: Synthetic peptide
QQHGTSPFT

SEQ ID NO: 2377 - protein, 118 aa, Artificial Sequence
  Description of Artificial Sequence: Synthetic polypeptide
EVQLVESGGGLVQPGGSLRLSCAASGFTFSSYDMHWVRQATGKGLEWVSTIGTAGDTYYPGSVKGRFTISRENARNSLFLQMNSLRAGDTAVYYCARGGDYYYGMDVWGQGTTVTVSS

SEQ ID NO: 2378 - protein, 108 aa, Artificial Sequence
  Description of Artificial Sequence: Synthetic polypeptide
EIVLTQSPGTLSLFPGERATLSCRASQNTYSSYLAWYQQKPGQAPRLLIYGASNRATGIPDRFSGSGSGTDFTLTISRLEPEDFAVYYCQQHGTSPFTFGPGTKVDIK

SEQ ID NO: 2379-2380 - skipped (2 entries)

SEQ ID NO: 2381 - protein, 5 aa, Artificial Sequence
  Description of Artificial Sequence: Synthetic peptide
GYYWS

SEQ ID NO: 2382 - protein, 16 aa, Artificial Sequence
  Description of Artificial Sequence: Synthetic peptide
EINQSGSTNYNPSLKS

SEQ ID NO: 2383 - protein, 7 aa, Artificial Sequence
  Description of Artificial Sequence: Synthetic peptide
VINWFDS

SEQ ID NO: 2384 - protein, 11 aa, Artificial Sequence
  Description of Artificial Sequence: Synthetic peptide
RASQGISSWLA

SEQ ID NO: 2385 - protein, 7 aa, Artificial Sequence
  Description of Artificial Sequence: Synthetic peptide
AASSFQS

SEQ ID NO: 2386 - protein, 9 aa, Artificial Sequence
  Description of Artificial Sequence: Synthetic peptide
QQANSFPYT

SEQ ID NO: 2387 - protein, 7 aa, Artificial Sequence
  Description of Artificial Sequence: Synthetic peptide
GGSFSGY

SEQ ID NO: 2388 - protein, 5 aa, Artificial Sequence
  Description of Artificial Sequence: Synthetic peptide
NQSGS

SEQ ID NO: 2389 - protein, 6 aa, Artificial Sequence
  Description of Artificial Sequence: Synthetic peptide
VINWFD

SEQ ID NO: 2390 - protein, 7 aa, Artificial Sequence
  Description of Artificial Sequence: Synthetic peptide
SQGISSW

SEQ ID NO: 2391 - protein, 3 aa, Artificial Sequence
  Description of Artificial Sequence: Synthetic peptide
AAS

SEQ ID NO: 2392 - protein, 6 aa, Artificial Sequence
  Description of Artificial Sequence: Synthetic peptide
ANSFPY

SEQ ID NO: 2393 - protein, 10 aa, Artificial Sequence
  Description of Artificial Sequence: Synthetic peptide
GGSFSGYYWS

SEQ ID NO: 2394 - protein, 9 aa, Artificial Sequence
  Description of Artificial Sequence: Synthetic peptide
EINQSGSTN

SEQ ID NO: 2395 - protein, 7 aa, Artificial Sequence
  Description of Artificial Sequence: Synthetic peptide
VINWFDS

SEQ ID NO: 2396 - protein, 11 aa, Artificial Sequence
  Description of Artificial Sequence: Synthetic peptide
RASQGISSWLA

SEQ ID NO: 2397 - protein, 7 aa, Artificial Sequence
  Description of Artificial Sequence: Synthetic peptide
AASSFQS

SEQ ID NO: 2398 - protein, 9 aa, Artificial Sequence
  Description of Artificial Sequence: Synthetic peptide
QQANSFPYT

SEQ ID NO: 2399 - protein, 6 aa, Artificial Sequence
  Description of Artificial Sequence: Synthetic peptide
SGYYWS

SEQ ID NO: 2400 - protein, 12 aa, Artificial Sequence
  Description of Artificial Sequence: Synthetic peptide
WIGEINQSGSTN

SEQ ID NO: 2401 - protein, 8 aa, Artificial Sequence
  Description of Artificial Sequence: Synthetic peptide
ARVINWFD

SEQ ID NO: 2402 - protein, 7 aa, Artificial Sequence
  Description of Artificial Sequence: Synthetic peptide
SSWLAWY

SEQ ID NO: 2403 - protein, 10 aa, Artificial Sequence
  Description of Artificial Sequence: Synthetic peptide
LLIYAASSFQ

SEQ ID NO: 2404 - protein, 8 aa, Artificial Sequence
  Description of Artificial Sequence: Synthetic peptide
QQANSFPY

SEQ ID NO: 2405 - protein, 8 aa, Artificial Sequence
  Description of Artificial Sequence: Synthetic peptide
GGSFSGYY

SEQ ID NO: 2406 - protein, 7 aa, Artificial Sequence
  Description of Artificial Sequence: Synthetic peptide
INQSGST

SEQ ID NO: 2407 - protein, 9 aa, Artificial Sequence
  Description of Artificial Sequence: Synthetic peptide
ARVINWFDS

SEQ ID NO: 2408 - protein, 6 aa, Artificial Sequence
  Description of Artificial Sequence: Synthetic peptide
QGISSW

SEQ ID NO: 2409 - protein, 3 aa, Artificial Sequence
  Description of Artificial Sequence: Synthetic peptide
AAS

SEQ ID NO: 2410 - protein, 9 aa, Artificial Sequence
  Description of Artificial Sequence: Synthetic peptide
QQANSFPYT

SEQ ID NO: 2411 - protein, 115 aa, Artificial Sequence
  Description of Artificial Sequence: Synthetic polypeptide
QVQLQQWGAGLLKPSETLSLTCAVYGGSFSGYYWSWIRQSPGKGLEWIGEINQSGSTNYNPSLKSRVTISVDTSKNQFSLKLSSVTAADTAVYYCARVINWFDSWGQGTLVTVSS

SEQ ID NO: 2412 - protein, 107 aa, Artificial Sequence
  Description of Artificial Sequence: Synthetic polypeptide
DIQMTQSPSSVSASVGDRVTITCRASQGISSWLAWYQQKPGKAPKLLIYAASSFQSGVPSRFSGSGSGTDFTLTISSLQTEDFATYYCQQANSFPYTFGQGTRLEIK

SEQ ID NO: 2413-2414 - skipped (2 entries)

SEQ ID NO: 2415 - protein, 5 aa, Artificial Sequence
  Description of Artificial Sequence: Synthetic peptide
SYWMS

SEQ ID NO: 2416 - protein, 17 aa, Artificial Sequence
  Description of Artificial Sequence: Synthetic peptide
NTKEDGSDKYYVDSVKG

SEQ ID NO: 2417 - protein, 10 aa, Artificial Sequence
  Description of Artificial Sequence: Synthetic peptide
EGGQWLALDY

SEQ ID NO: 2418 - protein, 11 aa, Artificial Sequence
  Description of Artificial Sequence: Synthetic peptide
RASQGISSWLA

SEQ ID NO: 2419 - protein, 7 aa, Artificial Sequence
  Description of Artificial Sequence: Synthetic peptide
GASSLQS

SEQ ID NO: 2420 - protein, 9 aa, Artificial Sequence
  Description of Artificial Sequence: Synthetic peptide
QQANSFPWT

SEQ ID NO: 2421 - protein, 7 aa, Artificial Sequence
  Description of Artificial Sequence: Synthetic peptide
GFTFSSY

SEQ ID NO: 2422 - protein, 6 aa, Artificial Sequence
  Description of Artificial Sequence: Synthetic peptide
KEDGSD

SEQ ID NO: 2423 - protein, 9 aa, Artificial Sequence
  Description of Artificial Sequence: Synthetic peptide
EGGQWLALD

SEQ ID NO: 2424 - protein, 7 aa, Artificial Sequence
  Description of Artificial Sequence: Synthetic peptide
SQGISSW

SEQ ID NO: 2425 - protein, 3 aa, Artificial Sequence
  Description of Artificial Sequence: Synthetic peptide
GAS

SEQ ID NO: 2426 - protein, 6 aa, Artificial Sequence
  Description of Artificial Sequence: Synthetic peptide
ANSFPW

SEQ ID NO: 2427 - protein, 10 aa, Artificial Sequence
  Description of Artificial Sequence: Synthetic peptide
GFTFSSYWMS

SEQ ID NO: 2428 - protein, 10 aa, Artificial Sequence
  Description of Artificial Sequence: Synthetic peptide
NTKEDGSDKY

SEQ ID NO: 2429 - protein, 10 aa, Artificial Sequence
  Description of Artificial Sequence: Synthetic peptide
EGGQWLALDY

SEQ ID NO: 2430 - protein, 11 aa, Artificial Sequence
  Description of Artificial Sequence: Synthetic peptide
RASQGISSWLA

SEQ ID NO: 2431 - protein, 7 aa, Artificial Sequence
  Description of Artificial Sequence: Synthetic peptide
GASSLQS

SEQ ID NO: 2432 - protein, 9 aa, Artificial Sequence
  Description of Artificial Sequence: Synthetic peptide
QQANSFPWT

SEQ ID NO: 2433 - protein, 6 aa, Artificial Sequence
  Description of Artificial Sequence: Synthetic peptide
SSYWMS

SEQ ID NO: 2434 - protein, 13 aa, Artificial Sequence
  Description of Artificial Sequence: Synthetic peptide
WVANTKEDGSDKY

SEQ ID NO: 2435 - protein, 11 aa, Artificial Sequence
  Description of Artificial Sequence: Synthetic peptide
AREGGQWLALD

SEQ ID NO: 2436 - protein, 7 aa, Artificial Sequence
  Description of Artificial Sequence: Synthetic peptide
SSWLAWY

SEQ ID NO: 2437 - protein, 10 aa, Artificial Sequence
  Description of Artificial Sequence: Synthetic peptide
LLIFGASSLQ

SEQ ID NO: 2438 - protein, 8 aa, Artificial Sequence
  Description of Artificial Sequence: Synthetic peptide
QQANSFPW

SEQ ID NO: 2439 - protein, 8 aa, Artificial Sequence
  Description of Artificial Sequence: Synthetic peptide
GFTFSSYW

SEQ ID NO: 2440 - protein, 8 aa, Artificial Sequence
  Description of Artificial Sequence: Synthetic peptide
TKEDGSDK

SEQ ID NO: 2441 - protein, 12 aa, Artificial Sequence
  Description of Artificial Sequence: Synthetic peptide
AREGGQWLALDY

SEQ ID NO: 2442 - protein, 6 aa, Artificial Sequence
  Description of Artificial Sequence: Synthetic peptide
QGISSW

SEQ ID NO: 2443 - protein, 3 aa, Artificial Sequence
  Description of Artificial Sequence: Synthetic peptide
GAS

SEQ ID NO: 2444 - protein, 9 aa, Artificial Sequence
  Description of Artificial Sequence: Synthetic peptide
QQANSFPWT

SEQ ID NO: 2445 - protein, 119 aa, Artificial Sequence
  Description of Artificial Sequence: Synthetic polypeptide
EVQLVESGGGLVQPGGSLRLSCVASGFTFSSYWMSWVRQAPGKGLEWVANTKEDGSDKYYVDSVKGRFTICRDNAKNSLYLQMNSLRAEDTAVYYCAREGGQWLALDYWGQGTLVTVSS

SEQ ID NO: 2446 - protein, 107 aa, Artificial Sequence
  Description of Artificial Sequence: Synthetic polypeptide
DIQMTQSPSSVSASVGDRVTINCRASQGISSWLAWYQQKPGKAPNLLIFGASSLQSGVPSRFSGSGFGTDFSLTITTLQPEDFATYHCQQANSFPWTFGQGTKVEIK

SEQ ID NO: 2447 - protein, 449 aa, Artificial Sequence
  Description of Artificial Sequence: Synthetic peptide
EVQLVESGGGLVQPGGSLRLSCVASGFTFSSYWMSWVRQAPGKGLEWVANTKEDGSDKYYVDSVKGRFTICRDNAKNSLYLQMNSLRAEDTAVYYCAREGGQWLALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2448 - protein, 214 aa, Artificial Sequence
  Description of Artificial Sequence: Synthetic peptide
DIQMTQSPSSVSASVGDRVTINCRASQGISSWLAWYQQKPGKAPNLLIFGASSLQSGVPSRFSGSGFGTDFSLTITTLQPEDFATYHCQQANSFPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2449 - protein, 5 aa, Artificial Sequence
  Description of Artificial Sequence: Synthetic peptide
SYDMH

SEQ ID NO: 2450 - protein, 16 aa, Artificial Sequence
  Description of Artificial Sequence: Synthetic peptide
TIGTADDTYYPGSVKG

SEQ ID NO: 2451 - protein, 10 aa, Artificial Sequence
  Description of Artificial Sequence: Synthetic peptide
GGDYYYGMDV

SEQ ID NO: 2452 - protein, 12 aa, Artificial Sequence
  Description of Artificial Sequence: Synthetic peptide
RASQSVYISYLA

SEQ ID NO: 2453 - protein, 7 aa, Artificial Sequence
  Description of Artificial Sequence: Synthetic peptide
GASSRAT

SEQ ID NO: 2454 - protein, 9 aa, Artificial Sequence
  Description of Artificial Sequence: Synthetic peptide
QQFGSSPFT

SEQ ID NO: 2455 - protein, 7 aa, Artificial Sequence
  Description of Artificial Sequence: Synthetic peptide
GFTFSSY

SEQ ID NO: 2456 - protein, 5 aa, Artificial Sequence
  Description of Artificial Sequence: Synthetic peptide
GTADD

SEQ ID NO: 2457 - protein, 9 aa, Artificial Sequence
  Description of Artificial Sequence: Synthetic peptide
GGDYYYGMD

SEQ ID NO: 2458 - protein, 8 aa, Artificial Sequence
  Description of Artificial Sequence: Synthetic peptide
SQSVYISY

SEQ ID NO: 2459 - protein, 3 aa, Artificial Sequence
  Description of Artificial Sequence: Synthetic peptide
GAS

SEQ ID NO: 2460 - protein, 6 aa, Artificial Sequence
  Description of Artificial Sequence: Synthetic peptide
FGSSPF

SEQ ID NO: 2461 - protein, 10 aa, Artificial Sequence
  Description of Artificial Sequence: Synthetic peptide
GFTFSSYDMH

SEQ ID NO: 2462 - protein, 9 aa, Artificial Sequence
  Description of Artificial Sequence: Synthetic peptide
TIGTADDTY

SEQ ID NO: 2463 - protein, 10 aa, Artificial Sequence
  Description of Artificial Sequence: Synthetic peptide
GGDYYYGMDV

SEQ ID NO: 2464 - protein, 12 aa, Artificial Sequence
  Description of Artificial Sequence: Synthetic peptide
RASQSVYISYLA

SEQ ID NO: 2465 - protein, 7 aa, Artificial Sequence
  Description of Artificial Sequence: Synthetic peptide
GASSRAT

SEQ ID NO: 2466 - protein, 9 aa, Artificial Sequence
  Description of Artificial Sequence: Synthetic peptide
QQFGSSPFT

SEQ ID NO: 2467 - protein, 6 aa, Artificial Sequence
  Description of Artificial Sequence: Synthetic peptide
SSYDMH

SEQ ID NO: 2468 - protein, 12 aa, Artificial Sequence
  Description of Artificial Sequence: Synthetic peptide
WVSTIGTADDTY

SEQ ID NO: 2469 - protein, 11 aa, Artificial Sequence
  Description of Artificial Sequence: Synthetic peptide
ARGGDYYYGMD

SEQ ID NO: 2470 - protein, 8 aa, Artificial Sequence
  Description of Artificial Sequence: Synthetic peptide
YISYLAWY

SEQ ID NO: 2471 - protein, 10 aa, Artificial Sequence
  Description of Artificial Sequence: Synthetic peptide
LLIYGASSRA

SEQ ID NO: 2472 - protein, 8 aa, Artificial Sequence
  Description of Artificial Sequence: Synthetic peptide
QQFGSSPF

SEQ ID NO: 2473 - protein, 8 aa, Artificial Sequence
  Description of Artificial Sequence: Synthetic peptide
GFTFSSYD

SEQ ID NO: 2474 - protein, 7 aa, Artificial Sequence
  Description of Artificial Sequence: Synthetic peptide
IGTADDT

SEQ ID NO: 2475 - protein, 12 aa, Artificial Sequence
  Description of Artificial Sequence: Synthetic peptide
ARGGDYYYGMDV

SEQ ID NO: 2476 - protein, 7 aa, Artificial Sequence
  Description of Artificial Sequence: Synthetic peptide
QSVYISY

SEQ ID NO: 2477 - protein, 3 aa, Artificial Sequence
  Description of Artificial Sequence: Synthetic peptide
GAS

SEQ ID NO: 2478 - protein, 9 aa, Artificial Sequence
  Description of Artificial Sequence: Synthetic peptide
QQFGSSPFT

SEQ ID NO: 2479 - protein, 118 aa, Artificial Sequence
  Description of Artificial Sequence: Synthetic polypeptide
EVQLVESGGGLVQPGGSLRLSCAASGFTFSSYDMHWVRQGTGKGLEWVSTIGTADDTYYPGSVKGRFTISRENAENSLYLQMNSLRAGDTAVYYCARGGDYYYGMDVWGQGTTVTVSS

SEQ ID NO: 2480 - protein, 108 aa, Artificial Sequence
  Description of Artificial Sequence: Synthetic polypeptide
EIVLAQSPGTLSLSPGERATLSCRASQSVYISYLAWYQQKPGQAPRLLIYGASSRATGIPDRFSGSGSGTDFTLTITRLEPEDFAVYYCQQFGSSPFTFGPGTKVDFK

SEQ ID NO: 2481-2482 - skipped (2 entries)

SEQ ID NO: 2483 - protein, 5 aa, Artificial Sequence
  Description of Artificial Sequence: Synthetic peptide
NYDMH

SEQ ID NO: 2484 - protein, 16 aa, Artificial Sequence
  Description of Artificial Sequence: Synthetic peptide
TIGTAGDTYYPGSVKG

SEQ ID NO: 2485 - protein, 10 aa, Artificial Sequence
  Description of Artificial Sequence: Synthetic peptide
GGDYYYGMDV

SEQ ID NO: 2486 - protein, 12 aa, Artificial Sequence
  Description of Artificial Sequence: Synthetic peptide
RASQSLSSVYLA

SEQ ID NO: 2487 - protein, 7 aa, Artificial Sequence
  Description of Artificial Sequence: Synthetic peptide
GASSRAT

SEQ ID NO: 2488 - protein, 9 aa, Artificial Sequence
  Description of Artificial Sequence: Synthetic peptide
QQYGSSPFT

SEQ ID NO: 2489 - protein, 7 aa, Artificial Sequence
  Description of Artificial Sequence: Synthetic peptide
GFTFRNY

SEQ ID NO: 2490 - protein, 5 aa, Artificial Sequence
  Description of Artificial Sequence: Synthetic peptide
GTAGD

SEQ ID NO: 2491 - protein, 9 aa, Artificial Sequence
  Description of Artificial Sequence: Synthetic peptide
GGDYYYGMD

SEQ ID NO: 2492 - protein, 8 aa, Artificial Sequence
  Description of Artificial Sequence: Synthetic peptide
SQSLSSVY

SEQ ID NO: 2493 - protein, 3 aa, Artificial Sequence
  Description of Artificial Sequence: Synthetic peptide
GAS

SEQ ID NO: 2494 - protein, 6 aa, Artificial Sequence
  Description of Artificial Sequence: Synthetic peptide
YGSSPF

SEQ ID NO: 2495 - protein, 10 aa, Artificial Sequence
  Description of Artificial Sequence: Synthetic peptide
GFTFRNYDMH

SEQ ID NO: 2496 - protein, 9 aa, Artificial Sequence
  Description of Artificial Sequence: Synthetic peptide
TIGTAGDTY

SEQ ID NO: 2497 - protein, 10 aa, Artificial Sequence
  Description of Artificial Sequence: Synthetic peptide
GGDYYYGMDV

SEQ ID NO: 2498 - protein, 12 aa, Artificial Sequence
  Description of Artificial Sequence: Synthetic peptide
RASQSLSSVYLA

SEQ ID NO: 2499 - protein, 7 aa, Artificial Sequence
  Description of Artificial Sequence: Synthetic peptide
GASSRAT

SEQ ID NO: 2500 - protein, 9 aa, Artificial Sequence
  Description of Artificial Sequence: Synthetic peptide
QQYGSSPFT

SEQ ID NO: 2501 - protein, 6 aa, Artificial Sequence
  Description of Artificial Sequence: Synthetic peptide
RNYDMH

SEQ ID NO: 2502 - protein, 12 aa, Artificial Sequence
  Description of Artificial Sequence: Synthetic peptide
WVSTIGTAGDTY

SEQ ID NO: 2503 - protein, 11 aa, Artificial Sequence
  Description of Artificial Sequence: Synthetic peptide
ARGGDYYYGMD

SEQ ID NO: 2504 - protein, 8 aa, Artificial Sequence
  Description of Artificial Sequence: Synthetic peptide
SSVYLAWY

SEQ ID NO: 2505 - protein, 10 aa, Artificial Sequence
  Description of Artificial Sequence: Synthetic peptide
LLIYGASSRA

SEQ ID NO: 2506 - protein, 8 aa, Artificial Sequence
  Description of Artificial Sequence: Synthetic peptide
QQYGSSPF

SEQ ID NO: 2507 - protein, 8 aa, Artificial Sequence
  Description of Artificial Sequence: Synthetic peptide
GFTFRNYD

SEQ ID NO: 2508 - protein, 7 aa, Artificial Sequence
  Description of Artificial Sequence: Synthetic peptide
IGTAGDT

SEQ ID NO: 2509 - protein, 12 aa, Artificial Sequence
  Description of Artificial Sequence: Synthetic peptide
ARGGDYYYGMDV

SEQ ID NO: 2510 - protein, 7 aa, Artificial Sequence
  Description of Artificial Sequence: Synthetic peptide
QSLSSVY

SEQ ID NO: 2511 - protein, 3 aa, Artificial Sequence
  Description of Artificial Sequence: Synthetic peptide
GAS

SEQ ID NO: 2512 - protein, 9 aa, Artificial Sequence
  Description of Artificial Sequence: Synthetic peptide
QQYGSSPFT

SEQ ID NO: 2513 - protein, 118 aa, Artificial Sequence
  Description of Artificial Sequence: Synthetic polypeptide
EVQLVESGGALVQPGGSLRLSCAASGFTFRNYDMHWVRQATGKGLEWVSTIGTAGDTYYPGSVKGRFTISRENAKNSLYLQMNSLRAGDTAVYYCARGGDYYYGMDVWGQGTTVTVSS

SEQ ID NO: 2514 - protein, 108 aa, Artificial Sequence
  Description of Artificial Sequence: Synthetic polypeptide
EIVLTQSPDTLSLSPGERATLSCRASQSLSSVYLAWYQQKPGQAPRLLIYGASSRATGIPDRFSGTGSGTDFTLTISRLEPEDFAVYYCQQYGSSPFTFGPGTKVDIK

SEQ ID NO: 2515 - protein, 448 aa, Artificial Sequence
  Description of Artificial Sequence: Synthetic peptide
EVQLVESGGALVQPGGSLRLSCAASGFTFRNYDMHWVRQATGKGLEWVSTIGTAGDTYYPGSVKGRFTISRENAKNSLYLQMNSLRAGDTAVYYCARGGDYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2516 - protein, 215 aa, Artificial Sequence
  Description of Artificial Sequence: Synthetic peptide
EIVLTQSPDTLSLSPGERATLSCRASQSLSSVYLAWYQQKPGQAPRLLIYGASSRATGIPDRFSGTGSGTDFTLTISRLEPEDFAVYYCQQYGSSPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2517 - protein, 5 aa, Artificial Sequence
  Description of Artificial Sequence: Synthetic peptide
HYYWS

SEQ ID NO: 2518 - protein, 16 aa, Artificial Sequence
  Description of Artificial Sequence: Synthetic peptide
YIHYSGTTNYNPSLKS

SEQ ID NO: 2519 - protein, 11 aa, Artificial Sequence
  Description of Artificial Sequence: Synthetic peptide
DQGFSSGGMDV

SEQ ID NO: 2520 - protein, 11 aa, Artificial Sequence
  Description of Artificial Sequence: Synthetic peptide
QASQDISNYLN

SEQ ID NO: 2521 - protein, 7 aa, Artificial Sequence
  Description of Artificial Sequence: Synthetic peptide
DASNLET

SEQ ID NO: 2522 - protein, 9 aa, Artificial Sequence
  Description of Artificial Sequence: Synthetic peptide
QQYDNLPLT

SEQ ID NO: 2523 - protein, 7 aa, Artificial Sequence
  Description of Artificial Sequence: Synthetic peptide
GGSISHY

SEQ ID NO: 2524 - protein, 5 aa, Artificial Sequence
  Description of Artificial Sequence: Synthetic peptide
HYSGT

SEQ ID NO: 2525 - protein, 10 aa, Artificial Sequence
  Description of Artificial Sequence: Synthetic peptide
DQGFSSGGMD

SEQ ID NO: 2526 - protein, 7 aa, Artificial Sequence
  Description of Artificial Sequence: Synthetic peptide
SQDISNY

SEQ ID NO: 2527 - protein, 3 aa, Artificial Sequence
  Description of Artificial Sequence: Synthetic peptide
DAS

SEQ ID NO: 2528 - protein, 6 aa, Artificial Sequence
  Description of Artificial Sequence: Synthetic peptide
YDNLPL

SEQ ID NO: 2529 - protein, 10 aa, Artificial Sequence
  Description of Artificial Sequence: Synthetic peptide
GGSISHYYWS

SEQ ID NO: 2530 - protein, 9 aa, Artificial Sequence
  Description of Artificial Sequence: Synthetic peptide
YIHYSGTTN

SEQ ID NO: 2531 - protein, 11 aa, Artificial Sequence
  Description of Artificial Sequence: Synthetic peptide
DQGFSSGGMDV

SEQ ID NO: 2532 - protein, 11 aa, Artificial Sequence
  Description of Artificial Sequence: Synthetic peptide
QASQDISNYLN

SEQ ID NO: 2533 - protein, 7 aa, Artificial Sequence
  Description of Artificial Sequence: Synthetic peptide
DASNLET

SEQ ID NO: 2534 - protein, 9 aa, Artificial Sequence
  Description of Artificial Sequence: Synthetic peptide
QQYDNLPLT

SEQ ID NO: 2535 - protein, 6 aa, Artificial Sequence
  Description of Artificial Sequence: Synthetic peptide
SHYYWS

SEQ ID NO: 2536 - protein, 12 aa, Artificial Sequence
  Description of Artificial Sequence: Synthetic peptide
WIGYIHYSGTTN

SEQ ID NO: 2537 - protein, 12 aa, Artificial Sequence
  Description of Artificial Sequence: Synthetic peptide
ARDQGFSSGGMD

SEQ ID NO: 2538 - protein, 7 aa, Artificial Sequence
  Description of Artificial Sequence: Synthetic peptide
SNYLNWY

SEQ ID NO: 2539 - protein, 10 aa, Artificial Sequence
  Description of Artificial Sequence: Synthetic peptide
LLIYDASNLE

SEQ ID NO: 2540 - protein, 8 aa, Artificial Sequence
  Description of Artificial Sequence: Synthetic peptide
QQYDNLPL

SEQ ID NO: 2541 - protein, 8 aa, Artificial Sequence
  Description of Artificial Sequence: Synthetic peptide
GGSISHYY

SEQ ID NO: 2542 - protein, 7 aa, Artificial Sequence
  Description of Artificial Sequence: Synthetic peptide
IHYSGTT

SEQ ID NO: 2543 - protein, 13 aa, Artificial Sequence
  Description of Artificial Sequence: Synthetic peptide
ARDQGFSSGGMDV

SEQ ID NO: 2544 - protein, 6 aa, Artificial Sequence
  Description of Artificial Sequence: Synthetic peptide
QDISNY

SEQ ID NO: 2545 - protein, 3 aa, Artificial Sequence
  Description of Artificial Sequence: Synthetic peptide
DAS

SEQ ID NO: 2546 - protein, 9 aa, Artificial Sequence
  Description of Artificial Sequence: Synthetic peptide
QQYDNLPLT

SEQ ID NO: 2547 - protein, 119 aa, Artificial Sequence
  Description of Artificial Sequence: Synthetic polypeptide
QVQLQESGPGLVKPSETLSLTCTVSGGSISHYYWSWIRQPPGKGLEWIGYIHYSGTTNYNPSLKSRVTISVDTSKNQLSLKLRSVTAADTAVYYCARDQGFSSGGMDVWGQGTTVTVSS

SEQ ID NO: 2548 - protein, 107 aa, Artificial Sequence
  Description of Artificial Sequence: Synthetic polypeptide
DIQMTQSPSSLSASVGDRVTITCQASQDISNYLNWYQQKPGKAPKLLIYDASNLETGVPSRFSGSGSGTDFTFAISSLQPEDIATYYCQQYDNLPLTFGGGTKVEIK

SEQ ID NO: 2549-2550 - skipped (2 entries)

SEQ ID NO: 2551 - protein, 5 aa, Artificial Sequence
  Description of Artificial Sequence: Synthetic peptide
NYDMH

SEQ ID NO: 2552 - protein, 16 aa, Artificial Sequence
  Description of Artificial Sequence: Synthetic peptide
TIGTAGDTYYPGSVKG

SEQ ID NO: 2553 - protein, 10 aa, Artificial Sequence
  Description of Artificial Sequence: Synthetic peptide
GGDFYYGLDV

SEQ ID NO: 2554 - protein, 12 aa, Artificial Sequence
  Description of Artificial Sequence: Synthetic peptide
RASQSVSSVYLA

SEQ ID NO: 2555 - protein, 7 aa, Artificial Sequence
  Description of Artificial Sequence: Synthetic peptide
GASSRAT

SEQ ID NO: 2556 - protein, 9 aa, Artificial Sequence
  Description of Artificial Sequence: Synthetic peptide
QQYGSSPFT

SEQ ID NO: 2557 - protein, 7 aa, Artificial Sequence
  Description of Artificial Sequence: Synthetic peptide
GFTFSNY

SEQ ID NO: 2558 - protein, 5 aa, Artificial Sequence
  Description of Artificial Sequence: Synthetic peptide
GTAGD

SEQ ID NO: 2559 - protein, 9 aa, Artificial Sequence
  Description of Artificial Sequence: Synthetic peptide
GGDFYYGLD

SEQ ID NO: 2560 - protein, 8 aa, Artificial Sequence
  Description of Artificial Sequence: Synthetic peptide
SQSVSSVY

SEQ ID NO: 2561 - protein, 3 aa, Artificial Sequence
  Description of Artificial Sequence: Synthetic peptide
GAS

SEQ ID NO: 2562 - protein, 6 aa, Artificial Sequence
  Description of Artificial Sequence: Synthetic peptide
YGSSPF

SEQ ID NO: 2563 - protein, 10 aa, Artificial Sequence
  Description of Artificial Sequence: Synthetic peptide
GFTFSNYDMH

SEQ ID NO: 2564 - protein, 9 aa, Artificial Sequence
  Description of Artificial Sequence: Synthetic peptide
TIGTAGDTY

SEQ ID NO: 2565 - protein, 10 aa, Artificial Sequence
  Description of Artificial Sequence: Synthetic peptide
GGDFYYGLDV

SEQ ID NO: 2566 - protein, 12 aa, Artificial Sequence
  Description of Artificial Sequence: Synthetic peptide
RASQSVSSVYLA

SEQ ID NO: 2567 - protein, 7 aa, Artificial Sequence
  Description of Artificial Sequence: Synthetic peptide
GASSRAT

SEQ ID NO: 2568 - protein, 9 aa, Artificial Sequence
  Description of Artificial Sequence: Synthetic peptide
QQYGSSPFT

SEQ ID NO: 2569 - protein, 6 aa, Artificial Sequence
  Description of Artificial Sequence: Synthetic peptide
SNYDMH

SEQ ID NO: 2570 - protein, 12 aa, Artificial Sequence
  Description of Artificial Sequence: Synthetic peptide
WVSTIGTAGDTY

SEQ ID NO: 2571 - protein, 11 aa, Artificial Sequence
  Description of Artificial Sequence: Synthetic peptide
ARGGDFYYGLD

SEQ ID NO: 2572 - protein, 8 aa, Artificial Sequence
  Description of Artificial Sequence: Synthetic peptide
SSVYLAWY

SEQ ID NO: 2573 - protein, 10 aa, Artificial Sequence
  Description of Artificial Sequence: Synthetic peptide
LLIYGASSRA

SEQ ID NO: 2574 - protein, 8 aa, Artificial Sequence
  Description of Artificial Sequence: Synthetic peptide
QQYGSSPF

SEQ ID NO: 2575 - protein, 8 aa, Artificial Sequence
  Description of Artificial Sequence: Synthetic peptide
GFTFSNYD

SEQ ID NO: 2576 - protein, 7 aa, Artificial Sequence
  Description of Artificial Sequence: Synthetic peptide
IGTAGDT

SEQ ID NO: 2577 - protein, 12 aa, Artificial Sequence
  Description of Artificial Sequence: Synthetic peptide
ARGGDFYYGLDV

SEQ ID NO: 2578 - protein, 7 aa, Artificial Sequence
  Description of Artificial Sequence: Synthetic peptide
QSVSSVY

SEQ ID NO: 2579 - protein, 3 aa, Artificial Sequence
  Description of Artificial Sequence: Synthetic peptide
GAS

SEQ ID NO: 2580 - protein, 9 aa, Artificial Sequence
  Description of Artificial Sequence: Synthetic peptide
QQYGSSPFT

SEQ ID NO: 2581 - protein, 118 aa, Artificial Sequence
  Description of Artificial Sequence: Synthetic polypeptide
EVQLVESGGGLVQPGGSLRLSCAASGFTFSNYDMHWVRQATGKGLEWVSTIGTAGDTYYPGSVKGRFTISRENAKNSLYLQMNSLRAGDTAVYYCARGGDFYYGLDVWGQGTTVTVSS

SEQ ID NO: 2582 - protein, 108 aa, Artificial Sequence
  Description of Artificial Sequence: Synthetic polypeptide
EIMLTQSPGTLSLSPGERATLSCRASQSVSSVYLAWYQQKPGQAPRLLIYGASSRATGIPDRFSGSGSGTDFTLTISRLEPEDFAVYYCQQYGSSPFTFGPGTKVDFK

SEQ ID NO: 2583-2584 - skipped (2 entries)

SEQ ID NO: 2585 - protein, 5 aa, Artificial Sequence
  Description of Artificial Sequence: Synthetic peptide
TYYWT

SEQ ID NO: 2586 - protein, 16 aa, Artificial Sequence
  Description of Artificial Sequence: Synthetic peptide
RVYTSGDTNYNPSLKS

SEQ ID NO: 2587 - protein, 16 aa, Artificial Sequence
  Description of Artificial Sequence: Synthetic peptide
DSGALYSWNYGDAFDI

SEQ ID NO: 2588 - protein, 11 aa, Artificial Sequence
  Description of Artificial Sequence: Synthetic peptide
RASQDISNYLA

SEQ ID NO: 2589 - protein, 7 aa, Artificial Sequence
  Description of Artificial Sequence: Synthetic peptide
AASSLQS

SEQ ID NO: 2590 - protein, 9 aa, Artificial Sequence
  Description of Artificial Sequence: Synthetic peptide
LQHNSYPRT

SEQ ID NO: 2591 - protein, 7 aa, Artificial Sequence
  Description of Artificial Sequence: Synthetic peptide
GGSISTY

SEQ ID NO: 2592 - protein, 5 aa, Artificial Sequence
  Description of Artificial Sequence: Synthetic peptide
YTSGD

SEQ ID NO: 2593 - protein, 15 aa, Artificial Sequence
  Description of Artificial Sequence: Synthetic peptide
DSGALYSWNYGDAFD

SEQ ID NO: 2594 - protein, 7 aa, Artificial Sequence
  Description of Artificial Sequence: Synthetic peptide
SQDISNY

SEQ ID NO: 2595 - protein, 3 aa, Artificial Sequence
  Description of Artificial Sequence: Synthetic peptide
AAS

SEQ ID NO: 2596 - protein, 6 aa, Artificial Sequence
  Description of Artificial Sequence: Synthetic peptide
HNSYPR

SEQ ID NO: 2597 - protein, 10 aa, Artificial Sequence
  Description of Artificial Sequence: Synthetic peptide
GGSISTYYWT

SEQ ID NO: 2598 - protein, 9 aa, Artificial Sequence
  Description of Artificial Sequence: Synthetic peptide
RVYTSGDTN

SEQ ID NO: 2599 - protein, 16 aa, Artificial Sequence
  Description of Artificial Sequence: Synthetic peptide
DSGALYSWNYGDAFDI

SEQ ID NO: 2600 - protein, 11 aa, Artificial Sequence
  Description of Artificial Sequence: Synthetic peptide
RASQDISNYLA

SEQ ID NO: 2601 - protein, 7 aa, Artificial Sequence
  Description of Artificial Sequence: Synthetic peptide
AASSLQS

SEQ ID NO: 2602 - protein, 9 aa, Artificial Sequence
  Description of Artificial Sequence: Synthetic peptide
LQHNSYPRT

SEQ ID NO: 2603 - protein, 6 aa, Artificial Sequence
  Description of Artificial Sequence: Synthetic peptide
STYYWT

SEQ ID NO: 2604 - protein, 12 aa, Artificial Sequence
  Description of Artificial Sequence: Synthetic peptide
WIGRVYTSGDTN

SEQ ID NO: 2605 - protein, 17 aa, Artificial Sequence
  Description of Artificial Sequence: Synthetic peptide
ARDSGALYSWNYGDAFD

SEQ ID NO: 2606 - protein, 7 aa, Artificial Sequence
  Description of Artificial Sequence: Synthetic peptide
SNYLAWF

SEQ ID NO: 2607 - protein, 10 aa, Artificial Sequence
  Description of Artificial Sequence: Synthetic peptide
RLIYAASSLQ

SEQ ID NO: 2608 - protein, 8 aa, Artificial Sequence
  Description of Artificial Sequence: Synthetic peptide
LQHNSYPR

SEQ ID NO: 2609 - protein, 8 aa, Artificial Sequence
  Description of Artificial Sequence: Synthetic peptide
GGSISTYY

SEQ ID NO: 2610 - protein, 7 aa, Artificial Sequence
  Description of Artificial Sequence: Synthetic peptide
VYTSGDT

SEQ ID NO: 2611 - protein, 18 aa, Artificial Sequence
  Description of Artificial Sequence: Synthetic peptide
ARDSGALYSWNYGDAFDI

SEQ ID NO: 2612 - protein, 6 aa, Artificial Sequence
  Description of Artificial Sequence: Synthetic peptide
QDISNY

SEQ ID NO: 2613 - protein, 3 aa, Artificial Sequence
  Description of Artificial Sequence: Synthetic peptide
AAS

SEQ ID NO: 2614 - protein, 9 aa, Artificial Sequence
  Description of Artificial Sequence: Synthetic peptide
LQHNSYPRT

SEQ ID NO: 2615 - protein, 124 aa, Artificial Sequence
  Description of Artificial Sequence: Synthetic polypeptide
QVQLQESGPGLVKPSETLSLTCTVSGGSISTYYWTWIRQPAGKGLEWIGRVYTSGDTNYNPSLKSRVAMSLDTSKNQFSLKLSSVTAADTAVYYCARDSGALYSWNYGDAFDIWGQGTMVTVSS

SEQ ID NO: 2616 - protein, 107 aa, Artificial Sequence
  Description of Artificial Sequence: Synthetic polypeptide
DIQMTQSPSAMSASVGDRVTITCRASQDISNYLAWFQQKPGKVPKRLIYAASSLQSGVPSRFSGSGSGTEFTLTISSLQPEDFATYYCLQHNSYPRTFGQGTKVEIK

SEQ ID NO: 2617-2618 - skipped (2 entries)

SEQ ID NO: 2619 - protein, 5 aa, Artificial Sequence
  Description of Artificial Sequence: Synthetic peptide
SFYWS

SEQ ID NO: 2620 - protein, 16 aa, Artificial Sequence
  Description of Artificial Sequence: Synthetic peptide
RIYTSGSTNYNPSLKS

SEQ ID NO: 2621 - protein, 12 aa, Artificial Sequence
  Description of Artificial Sequence: Synthetic peptide
ELEKRNYYGMDV

SEQ ID NO: 2622 - protein, 11 aa, Artificial Sequence
  Description of Artificial Sequence: Synthetic peptide
QASHDISNYLN

SEQ ID NO: 2623 - protein, 7 aa, Artificial Sequence
  Description of Artificial Sequence: Synthetic peptide
DASTLET

SEQ ID NO: 2624 - protein, 9 aa, Artificial Sequence
  Description of Artificial Sequence: Synthetic peptide
QQYDSLPLT

SEQ ID NO: 2625 - protein, 7 aa, Artificial Sequence
  Description of Artificial Sequence: Synthetic peptide
GGSISSF

SEQ ID NO: 2626 - protein, 5 aa, Artificial Sequence
  Description of Artificial Sequence: Synthetic peptide
YTSGS

SEQ ID NO: 2627 - protein, 11 aa, Artificial Sequence
  Description of Artificial Sequence: Synthetic peptide
ELEKRNYYGMD

SEQ ID NO: 2628 - protein, 7 aa, Artificial Sequence
  Description of Artificial Sequence: Synthetic peptide
SHDISNY

SEQ ID NO: 2629 - protein, 3 aa, Artificial Sequence
  Description of Artificial Sequence: Synthetic peptide
DAS

SEQ ID NO: 2630 - protein, 6 aa, Artificial Sequence
  Description of Artificial Sequence: Synthetic peptide
YDSLPL

SEQ ID NO: 2631 - protein, 10 aa, Artificial Sequence
  Description of Artificial Sequence: Synthetic peptide
GGSISSFYWS

SEQ ID NO: 2632 - protein, 9 aa, Artificial Sequence
  Description of Artificial Sequence: Synthetic peptide
RIYTSGSTN

SEQ ID NO: 2633 - protein, 12 aa, Artificial Sequence
  Description of Artificial Sequence: Synthetic peptide
ELEKRNYYGMDV

SEQ ID NO: 2634 - protein, 11 aa, Artificial Sequence
  Description of Artificial Sequence: Synthetic peptide
QASHDISNYLN

SEQ ID NO: 2635 - protein, 7 aa, Artificial Sequence
  Description of Artificial Sequence: Synthetic peptide
DASTLET

SEQ ID NO: 2636 - protein, 9 aa, Artificial Sequence
  Description of Artificial Sequence: Synthetic peptide
QQYDSLPLT

SEQ ID NO: 2637 - protein, 6 aa, Artificial Sequence
  Description of Artificial Sequence: Synthetic peptide
SSFYWS

SEQ ID NO: 2638 - protein, 12 aa, Artificial Sequence
  Description of Artificial Sequence: Synthetic peptide
WIGRIYTSGSTN

SEQ ID NO: 2639 - protein, 13 aa, Artificial Sequence
  Description of Artificial Sequence: Synthetic peptide
ARELEKRNYYGMD

SEQ ID NO: 2640 - protein, 7 aa, Artificial Sequence
  Description of Artificial Sequence: Synthetic peptide
SNYLNWY

SEQ ID NO: 2641 - protein, 10 aa, Artificial Sequence
  Description of Artificial Sequence: Synthetic peptide
LLIFDASTLE

SEQ ID NO: 2642 - protein, 8 aa, Artificial Sequence
  Description of Artificial Sequence: Synthetic peptide
QQYDSLPL

SEQ ID NO: 2643 - protein, 8 aa, Artificial Sequence
  Description of Artificial Sequence: Synthetic peptide
GGSISSFY

SEQ ID NO: 2644 - protein, 7 aa, Artificial Sequence
  Description of Artificial Sequence: Synthetic peptide
IYTSGST

SEQ ID NO: 2645 - protein, 14 aa, Artificial Sequence
  Description of Artificial Sequence: Synthetic peptide
ARELEKRNYYGMDV

SEQ ID NO: 2646 - protein, 6 aa, Artificial Sequence
  Description of Artificial Sequence: Synthetic peptide
HDISNY

SEQ ID NO: 2647 - protein, 3 aa, Artificial Sequence
  Description of Artificial Sequence: Synthetic peptide
DAS

SEQ ID NO: 2648 - protein, 9 aa, Artificial Sequence
  Description of Artificial Sequence: Synthetic peptide
QQYDSLPLT

SEQ ID NO: 2649 - protein, 120 aa, Artificial Sequence
  Description of Artificial Sequence: Synthetic polypeptide
QVQLQESGPGLVKPSETLSLTCTVSGGSISSFYWSWIRQPAGKGLEWIGRIYTSGSTNYNPSLKSRVTMSVDTSKNQFSLKLSSVTAADTAVYYCARELEKRNYYGMDVWGQGTTVTVSS

SEQ ID NO: 2650 - protein, 107 aa, Artificial Sequence
  Description of Artificial Sequence: Synthetic polypeptide
DIQMTQSPSSLSASVGDRVTITCQASHDISNYLNWYQQKPGKAPKLLIFDASTLETGVPSRFSGSGSGTYFTFTIRSLQPEDIATYYCQQYDSLPLTFGGGTKVEIK

SEQ ID NO: 2651-2652 - skipped (2 entries)

SEQ ID NO: 2653 - protein, 5 aa, Artificial Sequence
  Description of Artificial Sequence: Synthetic peptide
GYYWT

SEQ ID NO: 2654 - protein, 16 aa, Artificial Sequence
  Description of Artificial Sequence: Synthetic peptide
EINHSGTTNSNPSLKS

SEQ ID NO: 2655 - protein, 7 aa, Artificial Sequence
  Description of Artificial Sequence: Synthetic peptide
ELNWFDP

SEQ ID NO: 2656 - protein, 11 aa, Artificial Sequence
  Description of Artificial Sequence: Synthetic peptide
RASQDIANWLA

SEQ ID NO: 2657 - protein, 7 aa, Artificial Sequence
  Description of Artificial Sequence: Synthetic peptide
AASSLLG

SEQ ID NO: 2658 - protein, 9 aa, Artificial Sequence
  Description of Artificial Sequence: Synthetic peptide
QQANSFPYT

SEQ ID NO: 2659 - protein, 7 aa, Artificial Sequence
  Description of Artificial Sequence: Synthetic peptide
GGSFSGY

SEQ ID NO: 2660 - protein, 5 aa, Artificial Sequence
  Description of Artificial Sequence: Synthetic peptide
NHSGT

SEQ ID NO: 2661 - protein, 6 aa, Artificial Sequence
  Description of Artificial Sequence: Synthetic peptide
ELNWFD

SEQ ID NO: 2662 - protein, 7 aa, Artificial Sequence
  Description of Artificial Sequence: Synthetic peptide
SQDIANW

SEQ ID NO: 2663 - protein, 3 aa, Artificial Sequence
  Description of Artificial Sequence: Synthetic peptide
AAS

SEQ ID NO: 2664 - protein, 6 aa, Artificial Sequence
  Description of Artificial Sequence: Synthetic peptide
ANSFPY

SEQ ID NO: 2665 - protein, 10 aa, Artificial Sequence
  Description of Artificial Sequence: Synthetic peptide
GGSFSGYYWT

SEQ ID NO: 2666 - protein, 9 aa, Artificial Sequence
  Description of Artificial Sequence: Synthetic peptide
EINHSGTTN

SEQ ID NO: 2667 - protein, 7 aa, Artificial Sequence
  Description of Artificial Sequence: Synthetic peptide
ELNWFDP

SEQ ID NO: 2668 - protein, 11 aa, Artificial Sequence
  Description of Artificial Sequence: Synthetic peptide
RASQDIANWLA

SEQ ID NO: 2669 - protein, 7 aa, Artificial Sequence
  Description of Artificial Sequence: Synthetic peptide
AASSLLG

SEQ ID NO: 2670 - protein, 9 aa, Artificial Sequence
  Description of Artificial Sequence: Synthetic peptide
QQANSFPYT

SEQ ID NO: 2671 - protein, 6 aa, Artificial Sequence
  Description of Artificial Sequence: Synthetic peptide
SGYYWT

SEQ ID NO: 2672 - protein, 12 aa, Artificial Sequence
  Description of Artificial Sequence: Synthetic peptide
WIGEINHSGTTN

SEQ ID NO: 2673 - protein, 8 aa, Artificial Sequence
  Description of Artificial Sequence: Synthetic peptide
TRELNWFD

SEQ ID NO: 2674 - protein, 7 aa, Artificial Sequence
  Description of Artificial Sequence: Synthetic peptide
ANWLAWY

SEQ ID NO: 2675 - protein, 10 aa, Artificial Sequence
  Description of Artificial Sequence: Synthetic peptide
LLIYAASSLL

SEQ ID NO: 2676 - protein, 8 aa, Artificial Sequence
  Description of Artificial Sequence: Synthetic peptide
QQANSFPY

SEQ ID NO: 2677 - protein, 8 aa, Artificial Sequence
  Description of Artificial Sequence: Synthetic peptide
GGSFSGYY

SEQ ID NO: 2678 - protein, 7 aa, Artificial Sequence
  Description of Artificial Sequence: Synthetic peptide
INHSGTT

SEQ ID NO: 2679 - protein, 9 aa, Artificial Sequence
  Description of Artificial Sequence: Synthetic peptide
TRELNWFDP

SEQ ID NO: 2680 - protein, 6 aa, Artificial Sequence
  Description of Artificial Sequence: Synthetic peptide
QDIANW

SEQ ID NO: 2681 - protein, 3 aa, Artificial Sequence
  Description of Artificial Sequence: Synthetic peptide
AAS

SEQ ID NO: 2682 - protein, 9 aa, Artificial Sequence
  Description of Artificial Sequence: Synthetic peptide
QQANSFPYT

SEQ ID NO: 2683 - protein, 115 aa, Artificial Sequence
  Description of Artificial Sequence: Synthetic polypeptide
QVQLQQWGAGLLKPSETLSLTCDVYGGSFSGYYWTWIRQPPGKGLEWIGEINHSGTTNSNPSLKSRVTISVDTSKSQFSLRLSSVTAADTAVYFCTRELNWFDPWGQGTLVTVSS

SEQ ID NO: 2684 - protein, 107 aa, Artificial Sequence
  Description of Artificial Sequence: Synthetic polypeptide
DIQMTQSPSSVSASVGDRVTITCRASQDIANWLAWYQQKPGKAPQLLIYAASSLLGGVPSRFSGSGSGADFTLTISSLHPEDFATYYCQQANSFPYTFGQGTKLEIK

SEQ ID NO: 2685-2686 - skipped (2 entries)

SEQ ID NO: 2687 - protein, 5 aa, Artificial Sequence
  Description of Artificial Sequence: Synthetic peptide
SYDMH

SEQ ID NO: 2688 - protein, 16 aa, Artificial Sequence
  Description of Artificial Sequence: Synthetic peptide
TIGTAGDTYYPGSVKG

SEQ ID NO: 2689 - protein, 10 aa, Artificial Sequence
  Description of Artificial Sequence: Synthetic peptide
GGYYYYGMDV

SEQ ID NO: 2690 - protein, 12 aa, Artificial Sequence
  Description of Artificial Sequence: Synthetic peptide
RASQSVSSSYLA

SEQ ID NO: 2691 - protein, 7 aa, Artificial Sequence
  Description of Artificial Sequence: Synthetic peptide
GASSRAT

SEQ ID NO: 2692 - protein, 9 aa, Artificial Sequence
  Description of Artificial Sequence: Synthetic peptide
QQYGSSPFT

SEQ ID NO: 2693 - protein, 7 aa, Artificial Sequence
  Description of Artificial Sequence: Synthetic peptide
GFTFSSY

SEQ ID NO: 2694 - protein, 5 aa, Artificial Sequence
  Description of Artificial Sequence: Synthetic peptide
GTAGD

SEQ ID NO: 2695 - protein, 9 aa, Artificial Sequence
  Description of Artificial Sequence: Synthetic peptide
GGYYYYGMD

SEQ ID NO: 2696 - protein, 8 aa, Artificial Sequence
  Description of Artificial Sequence: Synthetic peptide
SQSVSSSY

SEQ ID NO: 2697 - protein, 3 aa, Artificial Sequence
  Description of Artificial Sequence: Synthetic peptide
GAS

SEQ ID NO: 2698 - protein, 6 aa, Artificial Sequence
  Description of Artificial Sequence: Synthetic peptide
YGSSPF

SEQ ID NO: 2699 - protein, 10 aa, Artificial Sequence
  Description of Artificial Sequence: Synthetic peptide
GFTFSSYDMH

SEQ ID NO: 2700 - protein, 9 aa, Artificial Sequence
  Description of Artificial Sequence: Synthetic peptide
TIGTAGDTY

SEQ ID NO: 2701 - protein, 10 aa, Artificial Sequence
  Description of Artificial Sequence: Synthetic peptide
GGYYYYGMDV

SEQ ID NO: 2702 - protein, 12 aa, Artificial Sequence
  Description of Artificial Sequence: Synthetic peptide
RASQSVSSSYLA

SEQ ID NO: 2703 - protein, 7 aa, Artificial Sequence
  Description of Artificial Sequence: Synthetic peptide
GASSRAT

SEQ ID NO: 2704 - protein, 9 aa, Artificial Sequence
  Description of Artificial Sequence: Synthetic peptide
QQYGSSPFT

SEQ ID NO: 2705 - protein, 6 aa, Artificial Sequence
  Description of Artificial Sequence: Synthetic peptide
SSYDMH

SEQ ID NO: 2706 - protein, 12 aa, Artificial Sequence
  Description of Artificial Sequence: Synthetic peptide
WVSTIGTAGDTY

SEQ ID NO: 2707 - protein, 11 aa, Artificial Sequence
  Description of Artificial Sequence: Synthetic peptide
ARGGYYYYGMD

SEQ ID NO: 2708 - protein, 8 aa, Artificial Sequence
  Description of Artificial Sequence: Synthetic peptide
SSSYLAWY

SEQ ID NO: 2709 - protein, 10 aa, Artificial Sequence
  Description of Artificial Sequence: Synthetic peptide
LLIHGASSRA

SEQ ID NO: 2710 - protein, 8 aa, Artificial Sequence
  Description of Artificial Sequence: Synthetic peptide
QQYGSSPF

SEQ ID NO: 2711 - protein, 8 aa, Artificial Sequence
  Description of Artificial Sequence: Synthetic peptide
GFTFSSYD

SEQ ID NO: 2712 - protein, 7 aa, Artificial Sequence
  Description of Artificial Sequence: Synthetic peptide
IGTAGDT

SEQ ID NO: 2713 - protein, 12 aa, Artificial Sequence
  Description of Artificial Sequence: Synthetic peptide
ARGGYYYYGMDV

SEQ ID NO: 2714 - protein, 7 aa, Artificial Sequence
  Description of Artificial Sequence: Synthetic peptide
QSVSSSY

SEQ ID NO: 2715 - protein, 3 aa, Artificial Sequence
  Description of Artificial Sequence: Synthetic peptide
GAS

SEQ ID NO: 2716 - protein, 9 aa, Artificial Sequence
  Description of Artificial Sequence: Synthetic peptide
QQYGSSPFT

SEQ ID NO: 2717 - protein, 118 aa, Artificial Sequence
  Description of Artificial Sequence: Synthetic polypeptide
EVQVVESGGGLVQPGGSLRLSCAASGFTFSSYDMHWVRQATGKGLEWVSTIGTAGDTYYPGSVKGRFTISRENAKNSLYLQMNSLRAGDTAVYYCARGGYYYYGMDVWGQGTTVTVSS

SEQ ID NO: 2718 - protein, 108 aa, Artificial Sequence
  Description of Artificial Sequence: Synthetic polypeptide
EIVLTQSPGTLSLSPGERATLSCRASQSVSSSYLAWYQQKPGQSPRLLIHGASSRATGIPDRVSGSGSGTDFTLTISRLEPEDFAVYYCQQYGSSPFTFGPGTKVDIK

SEQ ID NO: 2719-2720 - skipped (2 entries)

SEQ ID NO: 2721 - protein, 7 aa, Artificial Sequence
  Description of Artificial Sequence: Synthetic peptide
SGFYYWT

SEQ ID NO: 2722 - protein, 16 aa, Artificial Sequence
  Description of Artificial Sequence: Synthetic peptide
YISYSGNTYYNPSFKS

SEQ ID NO: 2723 - protein, 11 aa, Artificial Sequence
  Description of Artificial Sequence: Synthetic peptide
DRPSNFDAFDI

SEQ ID NO: 2724 - protein, 12 aa, Artificial Sequence
  Description of Artificial Sequence: Synthetic peptide
RASQSVSTSYLA

SEQ ID NO: 2725 - protein, 7 aa, Artificial Sequence
  Description of Artificial Sequence: Synthetic peptide
GASSRAT

SEQ ID NO: 2726 - protein, 9 aa, Artificial Sequence
  Description of Artificial Sequence: Synthetic peptide
QQYGRSPLT

SEQ ID NO: 2727 - protein, 9 aa, Artificial Sequence
  Description of Artificial Sequence: Synthetic peptide
GGSISSGFY

SEQ ID NO: 2728 - protein, 5 aa, Artificial Sequence
  Description of Artificial Sequence: Synthetic peptide
SYSGN

SEQ ID NO: 2729 - protein, 10 aa, Artificial Sequence
  Description of Artificial Sequence: Synthetic peptide
DRPSNFDAFD

SEQ ID NO: 2730 - protein, 8 aa, Artificial Sequence
  Description of Artificial Sequence: Synthetic peptide
SQSVSTSY

SEQ ID NO: 2731 - protein, 3 aa, Artificial Sequence
  Description of Artificial Sequence: Synthetic peptide
GAS

SEQ ID NO: 2732 - protein, 6 aa, Artificial Sequence
  Description of Artificial Sequence: Synthetic peptide
YGRSPL

SEQ ID NO: 2733 - protein, 12 aa, Artificial Sequence
  Description of Artificial Sequence: Synthetic peptide
GGSISSGFYYWT

SEQ ID NO: 2734 - protein, 9 aa, Artificial Sequence
  Description of Artificial Sequence: Synthetic peptide
YISYSGNTY

SEQ ID NO: 2735 - protein, 11 aa, Artificial Sequence
  Description of Artificial Sequence: Synthetic peptide
DRPSNFDAFDI

SEQ ID NO: 2736 - protein, 12 aa, Artificial Sequence
  Description of Artificial Sequence: Synthetic peptide
RASQSVSTSYLA

SEQ ID NO: 2737 - protein, 7 aa, Artificial Sequence
  Description of Artificial Sequence: Synthetic peptide
GASSRAT

SEQ ID NO: 2738 - protein, 9 aa, Artificial Sequence
  Description of Artificial Sequence: Synthetic peptide
QQYGRSPLT

SEQ ID NO: 2739 - protein, 8 aa, Artificial Sequence
  Description of Artificial Sequence: Synthetic peptide
SSGFYYWT

SEQ ID NO: 2740 - protein, 12 aa, Artificial Sequence
  Description of Artificial Sequence: Synthetic peptide
WIGYISYSGNTY

SEQ ID NO: 2741 - protein, 12 aa, Artificial Sequence
  Description of Artificial Sequence: Synthetic peptide
ARDRPSNFDAFD

SEQ ID NO: 2742 - protein, 8 aa, Artificial Sequence
  Description of Artificial Sequence: Synthetic peptide
STSYLAWY

SEQ ID NO: 2743 - protein, 10 aa, Artificial Sequence
  Description of Artificial Sequence: Synthetic peptide
LLIYGASSRA

SEQ ID NO: 2744 - protein, 8 aa, Artificial Sequence
  Description of Artificial Sequence: Synthetic peptide
QQYGRSPL

SEQ ID NO: 2745 - protein, 10 aa, Artificial Sequence
  Description of Artificial Sequence: Synthetic peptide
GGSISSGFYY

SEQ ID NO: 2746 - protein, 7 aa, Artificial Sequence
  Description of Artificial Sequence: Synthetic peptide
ISYSGNT

SEQ ID NO: 2747 - protein, 13 aa, Artificial Sequence
  Description of Artificial Sequence: Synthetic peptide
ARDRPSNFDAFDI

SEQ ID NO: 2748 - protein, 7 aa, Artificial Sequence
  Description of Artificial Sequence: Synthetic peptide
QSVSTSY

SEQ ID NO: 2749 - protein, 3 aa, Artificial Sequence
  Description of Artificial Sequence: Synthetic peptide
GAS

SEQ ID NO: 2750 - protein, 9 aa, Artificial Sequence
  Description of Artificial Sequence: Synthetic peptide
QQYGRSPLT

SEQ ID NO: 2751 - protein, 121 aa, Artificial Sequence
  Description of Artificial Sequence: Synthetic polypeptide
QVQLQESGPGLVKPSQTLSLTCTVSGGSISSGFYYWTWIRQHPGKGLEWIGYISYSGNTYYNPSFKSRLTISVDTSKSQFSLKLSSVTAADTAVYYCARDRPSNFDAFDIWGQGTMVTVSS

SEQ ID NO: 2752 - protein, 108 aa, Artificial Sequence
  Description of Artificial Sequence: Synthetic polypeptide
EIVLTQSPGTLSLSPGEGATLSCRASQSVSTSYLAWYQQKPGQAPRLLIYGASSRATGIPDRFSGSGSGTDFTLTISRLEPEDFAVYYCQQYGRSPLTFGPGTKVDIK

SEQ ID NO: 2753-2754 - skipped (2 entries)

SEQ ID NO: 2755 - protein, 5 aa, Artificial Sequence
  Description of Artificial Sequence: Synthetic peptide
SYWMS

SEQ ID NO: 2756 - protein, 17 aa, Artificial Sequence
  Description of Artificial Sequence: Synthetic peptide
NINEDGNEKYYVDSVKG

SEQ ID NO: 2757 - protein, 10 aa, Artificial Sequence
  Description of Artificial Sequence: Synthetic peptide
EGGQWLALDH

SEQ ID NO: 2758 - protein, 11 aa, Artificial Sequence
  Description of Artificial Sequence: Synthetic peptide
RASQGISSWLA

SEQ ID NO: 2759 - protein, 7 aa, Artificial Sequence
  Description of Artificial Sequence: Synthetic peptide
GASSLQS

SEQ ID NO: 2760 - protein, 9 aa, Artificial Sequence
  Description of Artificial Sequence: Synthetic peptide
QQANSFPWT

SEQ ID NO: 2761 - protein, 7 aa, Artificial Sequence
  Description of Artificial Sequence: Synthetic peptide
GFTFSSY

SEQ ID NO: 2762 - protein, 6 aa, Artificial Sequence
  Description of Artificial Sequence: Synthetic peptide
NEDGNE

SEQ ID NO: 2763 - protein, 9 aa, Artificial Sequence
  Description of Artificial Sequence: Synthetic peptide
EGGQWLALD

SEQ ID NO: 2764 - protein, 7 aa, Artificial Sequence
  Description of Artificial Sequence: Synthetic peptide
SQGISSW

SEQ ID NO: 2765 - protein, 3 aa, Artificial Sequence
  Description of Artificial Sequence: Synthetic peptide
GAS

SEQ ID NO: 2766 - protein, 6 aa, Artificial Sequence
  Description of Artificial Sequence: Synthetic peptide
ANSFPW

SEQ ID NO: 2767 - protein, 10 aa, Artificial Sequence
  Description of Artificial Sequence: Synthetic peptide
GFTFSSYWMS

SEQ ID NO: 2768 - protein, 10 aa, Artificial Sequence
  Description of Artificial Sequence: Synthetic peptide
NINEDGNEKY

SEQ ID NO: 2769 - protein, 10 aa, Artificial Sequence
  Description of Artificial Sequence: Synthetic peptide
EGGQWLALDH

SEQ ID NO: 2770 - protein, 11 aa, Artificial Sequence
  Description of Artificial Sequence: Synthetic peptide
RASQGISSWLA

SEQ ID NO: 2771 - protein, 7 aa, Artificial Sequence
  Description of Artificial Sequence: Synthetic peptide
GASSLQS

SEQ ID NO: 2772 - protein, 9 aa, Artificial Sequence
  Description of Artificial Sequence: Synthetic peptide
QQANSFPWT

SEQ ID NO: 2773 - protein, 6 aa, Artificial Sequence
  Description of Artificial Sequence: Synthetic peptide
SSYWMS

SEQ ID NO: 2774 - protein, 13 aa, Artificial Sequence
  Description of Artificial Sequence: Synthetic peptide
WVANINEDGNEKY

SEQ ID NO: 2775 - protein, 11 aa, Artificial Sequence
  Description of Artificial Sequence: Synthetic peptide
AREGGQWLALD

SEQ ID NO: 2776 - protein, 7 aa, Artificial Sequence
  Description of Artificial Sequence: Synthetic peptide
SSWLAWY

SEQ ID NO: 2777 - protein, 10 aa, Artificial Sequence
  Description of Artificial Sequence: Synthetic peptide
FLISGASSLQ

SEQ ID NO: 2778 - protein, 8 aa, Artificial Sequence
  Description of Artificial Sequence: Synthetic peptide
QQANSFPW

SEQ ID NO: 2779 - protein, 8 aa, Artificial Sequence
  Description of Artificial Sequence: Synthetic peptide
GFTFSSYW

SEQ ID NO: 2780 - protein, 8 aa, Artificial Sequence
  Description of Artificial Sequence: Synthetic peptide
INEDGNEK

SEQ ID NO: 2781 - protein, 12 aa, Artificial Sequence
  Description of Artificial Sequence: Synthetic peptide
AREGGQWLALDH

SEQ ID NO: 2782 - protein, 6 aa, Artificial Sequence
  Description of Artificial Sequence: Synthetic peptide
QGISSW

SEQ ID NO: 2783 - protein, 3 aa, Artificial Sequence
  Description of Artificial Sequence: Synthetic peptide
GAS

SEQ ID NO: 2784 - protein, 9 aa, Artificial Sequence
  Description of Artificial Sequence: Synthetic peptide
QQANSFPWT

SEQ ID NO: 2785 - protein, 119 aa, Artificial Sequence
  Description of Artificial Sequence: Synthetic polypeptide
EVQLVESGGGLVQPGGSLRLSCAASGFTFSSYWMSWVRQAPGKGLEWVANINEDGNEKYYVDSVKGRFTISRDNAKNSLFLQMNSLRAEDTAVYFCAREGGQWLALDHWGQGALVTVSS

SEQ ID NO: 2786 - protein, 107 aa, Artificial Sequence
  Description of Artificial Sequence: Synthetic polypeptide
DIQMTQSPSSVSASVGDRVTITCRASQGISSWLAWYQQKPGKAPKFLISGASSLQSGVPSRFSGSGSGTDFTLTISSLQPEDFATYYCQQANSFPWTFGQGTKVEFK

SEQ ID NO: 2787-2788 - skipped (2 entries)

SEQ ID NO: 2789 - protein, 5 aa, Artificial Sequence
  Description of Artificial Sequence: Synthetic peptide
SYWMS

SEQ ID NO: 2790 - protein, 17 aa, Artificial Sequence
  Description of Artificial Sequence: Synthetic peptide
NINEDGSEKNYVDSVKG

SEQ ID NO: 2791 - protein, 10 aa, Artificial Sequence
  Description of Artificial Sequence: Synthetic peptide
EGGQWLALDY

SEQ ID NO: 2792 - protein, 11 aa, Artificial Sequence
  Description of Artificial Sequence: Synthetic peptide
RASQGIRSWLA

SEQ ID NO: 2793 - protein, 7 aa, Artificial Sequence
  Description of Artificial Sequence: Synthetic peptide
GASSLQS

SEQ ID NO: 2794 - protein, 9 aa, Artificial Sequence
  Description of Artificial Sequence: Synthetic peptide
QQANSFPWT

SEQ ID NO: 2795 - protein, 7 aa, Artificial Sequence
  Description of Artificial Sequence: Synthetic peptide
GFTFSSY

SEQ ID NO: 2796 - protein, 6 aa, Artificial Sequence
  Description of Artificial Sequence: Synthetic peptide
NEDGSE

SEQ ID NO: 2797 - protein, 9 aa, Artificial Sequence
  Description of Artificial Sequence: Synthetic peptide
EGGQWLALD

SEQ ID NO: 2798 - protein, 7 aa, Artificial Sequence
  Description of Artificial Sequence: Synthetic peptide
SQGIRSW

SEQ ID NO: 2799 - protein, 3 aa, Artificial Sequence
  Description of Artificial Sequence: Synthetic peptide
GAS

SEQ ID NO: 2800 - protein, 6 aa, Artificial Sequence
  Description of Artificial Sequence: Synthetic peptide
ANSFPW

SEQ ID NO: 2801 - protein, 10 aa, Artificial Sequence
  Description of Artificial Sequence: Synthetic peptide
GFTFSSYWMS

SEQ ID NO: 2802 - protein, 10 aa, Artificial Sequence
  Description of Artificial Sequence: Synthetic peptide
NINEDGSEKN

SEQ ID NO: 2803 - protein, 10 aa, Artificial Sequence
  Description of Artificial Sequence: Synthetic peptide
EGGQWLALDY

SEQ ID NO: 2804 - protein, 11 aa, Artificial Sequence
  Description of Artificial Sequence: Synthetic peptide
RASQGIRSWLA

SEQ ID NO: 2805 - protein, 7 aa, Artificial Sequence
  Description of Artificial Sequence: Synthetic peptide
GASSLQS

SEQ ID NO: 2806 - protein, 9 aa, Artificial Sequence
  Description of Artificial Sequence: Synthetic peptide
QQANSFPWT

SEQ ID NO: 2807 - protein, 6 aa, Artificial Sequence
  Description of Artificial Sequence: Synthetic peptide
SSYWMS

SEQ ID NO: 2808 - protein, 13 aa, Artificial Sequence
  Description of Artificial Sequence: Synthetic peptide
WVANINEDGSEKN

SEQ ID NO: 2809 - protein, 11 aa, Artificial Sequence
  Description of Artificial Sequence: Synthetic peptide
AREGGQWLALD

SEQ ID NO: 2810 - protein, 7 aa, Artificial Sequence
  Description of Artificial Sequence: Synthetic peptide
RSWLAWY

SEQ ID NO: 2811 - protein, 10 aa, Artificial Sequence
  Description of Artificial Sequence: Synthetic peptide
LLICGASSLQ

SEQ ID NO: 2812 - protein, 8 aa, Artificial Sequence
  Description of Artificial Sequence: Synthetic peptide
QQANSFPW

SEQ ID NO: 2813 - protein, 8 aa, Artificial Sequence
  Description of Artificial Sequence: Synthetic peptide
GFTFSSYW

SEQ ID NO: 2814 - protein, 8 aa, Artificial Sequence
  Description of Artificial Sequence: Synthetic peptide
INEDGSEK

SEQ ID NO: 2815 - protein, 12 aa, Artificial Sequence
  Description of Artificial Sequence: Synthetic peptide
AREGGQWLALDY

SEQ ID NO: 2816 - protein, 6 aa, Artificial Sequence
  Description of Artificial Sequence: Synthetic peptide
QGIRSW

SEQ ID NO: 2817 - protein, 3 aa, Artificial Sequence
  Description of Artificial Sequence: Synthetic peptide
GAS

SEQ ID NO: 2818 - protein, 9 aa, Artificial Sequence
  Description of Artificial Sequence: Synthetic peptide
QQANSFPWT

SEQ ID NO: 2819 - protein, 119 aa, Artificial Sequence
  Description of Artificial Sequence: Synthetic polypeptide
EVQLVESGGGLVQPGGSLRLSCAASGFTFSSYWMSWVRQAPGKGLEWVANINEDGSEKNYVDSVKGRFTISRDNAKNSLCLQLNSLRAEDTAVYHCAREGGQWLALDYWGQGTLVTVSS

SEQ ID NO: 2820 - protein, 107 aa, Artificial Sequence
  Description of Artificial Sequence: Synthetic polypeptide
DIQMTQSPSSVSASVGDRVNITCRASQGIRSWLAWYQQKPGKTPKLLICGASSLQSGVPSRFSGSGSGTDFTLTISSLQPEDFATYYCQQANSFPWTFGQGTTVEIK

SEQ ID NO: 2821-2822 - skipped (2 entries)

SEQ ID NO: 2823 - protein, 5 aa, Artificial Sequence
  Description of Artificial Sequence: Synthetic peptide
GYYWS

SEQ ID NO: 2824 - protein, 16 aa, Artificial Sequence
  Description of Artificial Sequence: Synthetic peptide
EINQSGSTNYNPSLKS

SEQ ID NO: 2825 - protein, 7 aa, Artificial Sequence
  Description of Artificial Sequence: Synthetic peptide
VINWFDS

SEQ ID NO: 2826 - protein, 11 aa, Artificial Sequence
  Description of Artificial Sequence: Synthetic peptide
RASQGISSWLA

SEQ ID NO: 2827 - protein, 7 aa, Artificial Sequence
  Description of Artificial Sequence: Synthetic peptide
DASSFQS

SEQ ID NO: 2828 - protein, 9 aa, Artificial Sequence
  Description of Artificial Sequence: Synthetic peptide
QQANSFPYT

SEQ ID NO: 2829 - protein, 7 aa, Artificial Sequence
  Description of Artificial Sequence: Synthetic peptide
GGSFSGY

SEQ ID NO: 2830 - protein, 5 aa, Artificial Sequence
  Description of Artificial Sequence: Synthetic peptide
NQSGS

SEQ ID NO: 2831 - protein, 6 aa, Artificial Sequence
  Description of Artificial Sequence: Synthetic peptide
VINWFD

SEQ ID NO: 2832 - protein, 7 aa, Artificial Sequence
  Description of Artificial Sequence: Synthetic peptide
SQGISSW

SEQ ID NO: 2833 - protein, 3 aa, Artificial Sequence
  Description of Artificial Sequence: Synthetic peptide
DAS

SEQ ID NO: 2834 - protein, 6 aa, Artificial Sequence
  Description of Artificial Sequence: Synthetic peptide
ANSFPY

SEQ ID NO: 2835 - protein, 10 aa, Artificial Sequence
  Description of Artificial Sequence: Synthetic peptide
GGSFSGYYWS

SEQ ID NO: 2836 - protein, 9 aa, Artificial Sequence
  Description of Artificial Sequence: Synthetic peptide
EINQSGSTN

SEQ ID NO: 2837 - protein, 7 aa, Artificial Sequence
  Description of Artificial Sequence: Synthetic peptide
VINWFDS

SEQ ID NO: 2838 - protein, 11 aa, Artificial Sequence
  Description of Artificial Sequence: Synthetic peptide
RASQGISSWLA

SEQ ID NO: 2839 - protein, 7 aa, Artificial Sequence
  Description of Artificial Sequence: Synthetic peptide
DASSFQS

SEQ ID NO: 2840 - protein, 9 aa, Artificial Sequence
  Description of Artificial Sequence: Synthetic peptide
QQANSFPYT

SEQ ID NO: 2841 - protein, 6 aa, Artificial Sequence
  Description of Artificial Sequence: Synthetic peptide
SGYYWS

SEQ ID NO: 2842 - protein, 12 aa, Artificial Sequence
  Description of Artificial Sequence: Synthetic peptide
WIGEINQSGSTN

SEQ ID NO: 2843 - protein, 8 aa, Artificial Sequence
  Description of Artificial Sequence: Synthetic peptide
ARVINWFD

SEQ ID NO: 2844 - protein, 7 aa, Artificial Sequence
  Description of Artificial Sequence: Synthetic peptide
SSWLAWY

SEQ ID NO: 2845 - protein, 10 aa, Artificial Sequence
  Description of Artificial Sequence: Synthetic peptide
LLIYDASSFQ

SEQ ID NO: 2846 - protein, 8 aa, Artificial Sequence
  Description of Artificial Sequence: Synthetic peptide
QQANSFPY

SEQ ID NO: 2847 - protein, 8 aa, Artificial Sequence
  Description of Artificial Sequence: Synthetic peptide
GGSFSGYY

SEQ ID NO: 2848 - protein, 7 aa, Artificial Sequence
  Description of Artificial Sequence: Synthetic peptide
INQSGST

SEQ ID NO: 2849 - protein, 9 aa, Artificial Sequence
  Description of Artificial Sequence: Synthetic peptide
ARVINWFDS

SEQ ID NO: 2850 - protein, 6 aa, Artificial Sequence
  Description of Artificial Sequence: Synthetic peptide
QGISSW

SEQ ID NO: 2851 - protein, 3 aa, Artificial Sequence
  Description of Artificial Sequence: Synthetic peptide
DAS

SEQ ID NO: 2852 - protein, 9 aa, Artificial Sequence
  Description of Artificial Sequence: Synthetic peptide
QQANSFPYT

SEQ ID NO: 2853 - protein, 115 aa, Artificial Sequence
  Description of Artificial Sequence: Synthetic polypeptide
QVQLQQWGAGLLKPSETLSLTCAVYGGSFSGYYWSWIRQSPGKGLEWIGEINQSGSTNYNPSLKSRVTISVDTSKDQFSLKLSSVTAADTAVYYCARVINWFDSWGQGSLVTVSS

SEQ ID NO: 2854 - protein, 107 aa, Artificial Sequence
  Description of Artificial Sequence: Synthetic polypeptide
DIQMTQSPSSVSASVGDRVTITCRASQGISSWLAWYQQKPGNAPKLLIYDASSFQSGVPSRFSGSGSGTDFTLTISSLQTEDFATYYCQQANSFPYTFGQGTKLEIK

SEQ ID NO: 2855-2856 - skipped (2 entries)

SEQ ID NO: 2857 - protein, 5 aa, Artificial Sequence
  Description of Artificial Sequence: Synthetic peptide
SYWMS

SEQ ID NO: 2858 - protein, 17 aa, Artificial Sequence
  Description of Artificial Sequence: Synthetic peptide
NINQDGGEKYYVDSVKG

SEQ ID NO: 2859 - protein, 10 aa, Artificial Sequence
  Description of Artificial Sequence: Synthetic peptide
EGGQWLALDY

SEQ ID NO: 2860 - protein, 11 aa, Artificial Sequence
  Description of Artificial Sequence: Synthetic peptide
RASQGISSWLT

SEQ ID NO: 2861 - protein, 7 aa, Artificial Sequence
  Description of Artificial Sequence: Synthetic peptide
AASSLQS

SEQ ID NO: 2862 - protein, 9 aa, Artificial Sequence
  Description of Artificial Sequence: Synthetic peptide
QQANSFPWT

SEQ ID NO: 2863 - protein, 7 aa, Artificial Sequence
  Description of Artificial Sequence: Synthetic peptide
GFTFSSY

SEQ ID NO: 2864 - protein, 6 aa, Artificial Sequence
  Description of Artificial Sequence: Synthetic peptide
NQDGGE

SEQ ID NO: 2865 - protein, 9 aa, Artificial Sequence
  Description of Artificial Sequence: Synthetic peptide
EGGQWLALD

SEQ ID NO: 2866 - protein, 7 aa, Artificial Sequence
  Description of Artificial Sequence: Synthetic peptide
SQGISSW

SEQ ID NO: 2867 - protein, 3 aa, Artificial Sequence
  Description of Artificial Sequence: Synthetic peptide
AAS

SEQ ID NO: 2868 - protein, 6 aa, Artificial Sequence
  Description of Artificial Sequence: Synthetic peptide
ANSFPW

SEQ ID NO: 2869 - protein, 10 aa, Artificial Sequence
  Description of Artificial Sequence: Synthetic peptide
GFTFSSYWMS

SEQ ID NO: 2870 - protein, 10 aa, Artificial Sequence
  Description of Artificial Sequence: Synthetic peptide
NINQDGGEKY

SEQ ID NO: 2871 - protein, 10 aa, Artificial Sequence
  Description of Artificial Sequence: Synthetic peptide
EGGQWLALDY

SEQ ID NO: 2872 - protein, 11 aa, Artificial Sequence
  Description of Artificial Sequence: Synthetic peptide
RASQGISSWLT

SEQ ID NO: 2873 - protein, 7 aa, Artificial Sequence
  Description of Artificial Sequence: Synthetic peptide
AASSLQS

SEQ ID NO: 2874 - protein, 9 aa, Artificial Sequence
  Description of Artificial Sequence: Synthetic peptide
QQANSFPWT

SEQ ID NO: 2875 - protein, 6 aa, Artificial Sequence
  Description of Artificial Sequence: Synthetic peptide
SSYWMS

SEQ ID NO: 2876 - protein, 13 aa, Artificial Sequence
  Description of Artificial Sequence: Synthetic peptide
WVANINQDGGEKY

SEQ ID NO: 2877 - protein, 11 aa, Artificial Sequence
  Description of Artificial Sequence: Synthetic peptide
VREGGQWLALD

SEQ ID NO: 2878 - protein, 7 aa, Artificial Sequence
  Description of Artificial Sequence: Synthetic peptide
SSWLTWY

SEQ ID NO: 2879 - protein, 10 aa, Artificial Sequence
  Description of Artificial Sequence: Synthetic peptide
FLIYAASSLQ

SEQ ID NO: 2880 - protein, 8 aa, Artificial Sequence
  Description of Artificial Sequence: Synthetic peptide
QQANSFPW

SEQ ID NO: 2881 - protein, 8 aa, Artificial Sequence
  Description of Artificial Sequence: Synthetic peptide
GFTFSSYW

SEQ ID NO: 2882 - protein, 8 aa, Artificial Sequence
  Description of Artificial Sequence: Synthetic peptide
INQDGGEK

SEQ ID NO: 2883 - protein, 12 aa, Artificial Sequence
  Description of Artificial Sequence: Synthetic peptide
VREGGQWLALDY

SEQ ID NO: 2884 - protein, 6 aa, Artificial Sequence
  Description of Artificial Sequence: Synthetic peptide
QGISSW

SEQ ID NO: 2885 - protein, 3 aa, Artificial Sequence
  Description of Artificial Sequence: Synthetic peptide
AAS

SEQ ID NO: 2886 - protein, 9 aa, Artificial Sequence
  Description of Artificial Sequence: Synthetic peptide
QQANSFPWT

SEQ ID NO: 2887 - protein, 119 aa, Artificial Sequence
  Description of Artificial Sequence: Synthetic polypeptide
EVQLVESGGGLVQPGGSLRLSCAASGFTFSSYWMSWVRQAPGKGLEWVANINQDGGEKYYVDSVKGRFTISRDNAKNSLYLQMNSLRAEDTAVYYCVREGGQWLALDYWGQGTLVTVSS

SEQ ID NO: 2888 - protein, 107 aa, Artificial Sequence
  Description of Artificial Sequence: Synthetic polypeptide
DIQMTQSPSSVSASVGDRVTITCRASQGISSWLTWYQQKPGKAPKFLIYAASSLQSGVPSRFSGSGFGTDFTLTISSLQPEDFATYYCQQANSFPWTFGQGTKVEIK

SEQ ID NO: 2889-2890 - skipped (2 entries)

SEQ ID NO: 2891 - protein, 5 aa, Artificial Sequence
  Description of Artificial Sequence: Synthetic peptide
SYYWS

SEQ ID NO: 2892 - protein, 16 aa, Artificial Sequence
  Description of Artificial Sequence: Synthetic peptide
YIYYSGSTNYNPSLKS

SEQ ID NO: 2893 - protein, 11 aa, Artificial Sequence
  Description of Artificial Sequence: Synthetic peptide
EGEQWFYGLDV

SEQ ID NO: 2894 - protein, 12 aa, Artificial Sequence
  Description of Artificial Sequence: Synthetic peptide
RASQSVSSTYLA

SEQ ID NO: 2895 - protein, 7 aa, Artificial Sequence
  Description of Artificial Sequence: Synthetic peptide
GSSSRAT

SEQ ID NO: 2896 - protein, 10 aa, Artificial Sequence
  Description of Artificial Sequence: Synthetic peptide
QQYGNSFPIT

SEQ ID NO: 2897 - protein, 7 aa, Artificial Sequence
  Description of Artificial Sequence: Synthetic peptide
GGSISSY

SEQ ID NO: 2898 - protein, 5 aa, Artificial Sequence
  Description of Artificial Sequence: Synthetic peptide
YYSGS

SEQ ID NO: 2899 - protein, 10 aa, Artificial Sequence
  Description of Artificial Sequence: Synthetic peptide
EGEQWFYGLD

SEQ ID NO: 2900 - protein, 8 aa, Artificial Sequence
  Description of Artificial Sequence: Synthetic peptide
SQSVSSTY

SEQ ID NO: 2901 - protein, 3 aa, Artificial Sequence
  Description of Artificial Sequence: Synthetic peptide
GSS

SEQ ID NO: 2902 - protein, 7 aa, Artificial Sequence
  Description of Artificial Sequence: Synthetic peptide
YGNSFPI

SEQ ID NO: 2903 - protein, 10 aa, Artificial Sequence
  Description of Artificial Sequence: Synthetic peptide
GGSISSYYWS

SEQ ID NO: 2904 - protein, 9 aa, Artificial Sequence
  Description of Artificial Sequence: Synthetic peptide
YIYYSGSTN

SEQ ID NO: 2905 - protein, 11 aa, Artificial Sequence
  Description of Artificial Sequence: Synthetic peptide
EGEQWFYGLDV

SEQ ID NO: 2906 - protein, 12 aa, Artificial Sequence
  Description of Artificial Sequence: Synthetic peptide
RASQSVSSTYLA

SEQ ID NO: 2907 - protein, 7 aa, Artificial Sequence
  Description of Artificial Sequence: Synthetic peptide
GSSSRAT

SEQ ID NO: 2908 - protein, 10 aa, Artificial Sequence
  Description of Artificial Sequence: Synthetic peptide
QQYGNSFPIT

SEQ ID NO: 2909 - protein, 6 aa, Artificial Sequence
  Description of Artificial Sequence: Synthetic peptide
SSYYWS

SEQ ID NO: 2910 - protein, 12 aa, Artificial Sequence
  Description of Artificial Sequence: Synthetic peptide
WIGYIYYSGSTN

SEQ ID NO: 2911 - protein, 12 aa, Artificial Sequence
  Description of Artificial Sequence: Synthetic peptide
AREGEQWFYGLD

SEQ ID NO: 2912 - protein, 8 aa, Artificial Sequence
  Description of Artificial Sequence: Synthetic peptide
SSTYLAWY

SEQ ID NO: 2913 - protein, 10 aa, Artificial Sequence
  Description of Artificial Sequence: Synthetic peptide
LLIYGSSSRA

SEQ ID NO: 2914 - protein, 9 aa, Artificial Sequence
  Description of Artificial Sequence: Synthetic peptide
QQYGNSFPI

SEQ ID NO: 2915 - protein, 8 aa, Artificial Sequence
  Description of Artificial Sequence: Synthetic peptide
GGSISSYY

SEQ ID NO: 2916 - protein, 7 aa, Artificial Sequence
  Description of Artificial Sequence: Synthetic peptide
IYYSGST

SEQ ID NO: 2917 - protein, 13 aa, Artificial Sequence
  Description of Artificial Sequence: Synthetic peptide
AREGEQWFYGLDV

SEQ ID NO: 2918 - protein, 7 aa, Artificial Sequence
  Description of Artificial Sequence: Synthetic peptide
QSVSSTY

SEQ ID NO: 2919 - protein, 3 aa, Artificial Sequence
  Description of Artificial Sequence: Synthetic peptide
GSS

SEQ ID NO: 2920 - protein, 10 aa, Artificial Sequence
  Description of Artificial Sequence: Synthetic peptide
QQYGNSFPIT

SEQ ID NO: 2921 - protein, 119 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCAREGEQWFYGLDVWGQGTTVTVSS

SEQ ID NO: 2922 - protein, 109 aa, Artificial Sequence
  Description of Artificial Sequence: Synthetic polypeptide
EIVLTQSPGTLSLSPGERATLSCRASQSVSSTYLAWYQQKPGQAPRLLIYGSSSRATGIPDRFSGSGSGTDFTLTISRLEPEDFAVYYCQQYGNSFPITFGQGTRLEIK

SEQ ID NO: 2923-2924 - skipped (2 entries)

SEQ ID NO: 2925 - protein, 5 aa, Artificial Sequence
  Description of Artificial Sequence: Synthetic peptide
SYYWN

SEQ ID NO: 2926 - protein, 16 aa, Artificial Sequence
  Description of Artificial Sequence: Synthetic peptide
RIYTSGSTNYNPSLKS

SEQ ID NO: 2927 - protein, 10 aa, Artificial Sequence
  Description of Artificial Sequence: Synthetic peptide
DPGYSDAFNI

SEQ ID NO: 2928 - protein, 11 aa, Artificial Sequence
  Description of Artificial Sequence: Synthetic peptide
QASQDISNYLN

SEQ ID NO: 2929 - protein, 7 aa, Artificial Sequence
  Description of Artificial Sequence: Synthetic peptide
DASNLET

SEQ ID NO: 2930 - protein, 9 aa, Artificial Sequence
  Description of Artificial Sequence: Synthetic peptide
QQCDNLPLT

SEQ ID NO: 2931 - protein, 7 aa, Artificial Sequence
  Description of Artificial Sequence: Synthetic peptide
GGSITSY

SEQ ID NO: 2932 - protein, 5 aa, Artificial Sequence
  Description of Artificial Sequence: Synthetic peptide
YTSGS

SEQ ID NO: 2933 - protein, 9 aa, Artificial Sequence
  Description of Artificial Sequence: Synthetic peptide
DPGYSDAFN

SEQ ID NO: 2934 - protein, 7 aa, Artificial Sequence
  Description of Artificial Sequence: Synthetic peptide
SQDISNY

SEQ ID NO: 2935 - protein, 3 aa, Artificial Sequence
  Description of Artificial Sequence: Synthetic peptide
DAS

SEQ ID NO: 2936 - protein, 6 aa, Artificial Sequence
  Description of Artificial Sequence: Synthetic peptide
CDNLPL

SEQ ID NO: 2937 - protein, 10 aa, Artificial Sequence
  Description of Artificial Sequence: Synthetic peptide
GGSITSYYWN

SEQ ID NO: 2938 - protein, 9 aa, Artificial Sequence
  Description of Artificial Sequence: Synthetic peptide
RIYTSGSTN

SEQ ID NO: 2939 - protein, 10 aa, Artificial Sequence
  Description of Artificial Sequence: Synthetic peptide
DPGYSDAFNI

SEQ ID NO: 2940 - protein, 11 aa, Artificial Sequence
  Description of Artificial Sequence: Synthetic peptide
QASQDISNYLN

SEQ ID NO: 2941 - protein, 7 aa, Artificial Sequence
  Description of Artificial Sequence: Synthetic peptide
DASNLET

SEQ ID NO: 2942 - protein, 9 aa, Artificial Sequence
  Description of Artificial Sequence: Synthetic peptide
QQCDNLPLT

SEQ ID NO: 2943 - protein, 6 aa, Artificial Sequence
  Description of Artificial Sequence: Synthetic peptide
TSYYWN

SEQ ID NO: 2944 - protein, 12 aa, Artificial Sequence
  Description of Artificial Sequence: Synthetic peptide
WIGRIYTSGSTN

SEQ ID NO: 2945 - protein, 11 aa, Artificial Sequence
  Description of Artificial Sequence: Synthetic peptide
ARDPGYSDAFN

SEQ ID NO: 2946 - protein, 7 aa, Artificial Sequence
  Description of Artificial Sequence: Synthetic peptide
SNYLNWY

SEQ ID NO: 2947 - protein, 10 aa, Artificial Sequence
  Description of Artificial Sequence: Synthetic peptide
LLIYDASNLE

SEQ ID NO: 2948 - protein, 8 aa, Artificial Sequence
  Description of Artificial Sequence: Synthetic peptide
QQCDNLPL

SEQ ID NO: 2949 - protein, 8 aa, Artificial Sequence
  Description of Artificial Sequence: Synthetic peptide
GGSITSYY

SEQ ID NO: 2950 - protein, 7 aa, Artificial Sequence
  Description of Artificial Sequence: Synthetic peptide
IYTSGST

SEQ ID NO: 2951 - protein, 12 aa, Artificial Sequence
  Description of Artificial Sequence: Synthetic peptide
ARDPGYSDAFNI

SEQ ID NO: 2952 - protein, 6 aa, Artificial Sequence
  Description of Artificial Sequence: Synthetic peptide
QDISNY

SEQ ID NO: 2953 - protein, 3 aa, Artificial Sequence
  Description of Artificial Sequence: Synthetic peptide
DAS

SEQ ID NO: 2954 - protein, 9 aa, Artificial Sequence
  Description of Artificial Sequence: Synthetic peptide
QQCDNLPLT

SEQ ID NO: 2955 - protein, 118 aa, Artificial Sequence
  Description of Artificial Sequence: Synthetic polypeptide
QVQLQESGPGLVKPSETLSLTCTASGGSITSYYWNWIRQPAGKGLEWIGRIYTSGSTNYNPSLKSRVTMSVDTSKNQFSLKLSSVTAADTAVYYCARDPGYSDAFNIWGQGTMVTVSS

SEQ ID NO: 2956 - protein, 107 aa, Artificial Sequence
  Description of Artificial Sequence: Synthetic polypeptide
DIQMTQSPSSLSASVGDRVTITCQASQDISNYLNWYQQKPGKAPKLLIYDASNLETGVPSRFSGSGSGTDFTFAISSLQPEDIATYYCQQCDNLPLTFGGGTKVEIK

SEQ ID NO: 2957-2958 - skipped (2 entries)

SEQ ID NO: 2959 - protein, 5 aa, Artificial Sequence
  Description of Artificial Sequence: Synthetic peptide
GYYWS

SEQ ID NO: 2960 - protein, 16 aa, Artificial Sequence
  Description of Artificial Sequence: Synthetic peptide
EINHSGSTNYNPSLKS

SEQ ID NO: 2961 - protein, 7 aa, Artificial Sequence
  Description of Artificial Sequence: Synthetic peptide
LINWFDP

SEQ ID NO: 2962 - protein, 11 aa, Artificial Sequence
  Description of Artificial Sequence: Synthetic peptide
RASQDISNWLA

SEQ ID NO: 2963 - protein, 7 aa, Artificial Sequence
  Description of Artificial Sequence: Synthetic peptide
AASSLQS

SEQ ID NO: 2964 - protein, 9 aa, Artificial Sequence
  Description of Artificial Sequence: Synthetic peptide
QQANSFPYT

SEQ ID NO: 2965 - protein, 7 aa, Artificial Sequence
  Description of Artificial Sequence: Synthetic peptide
GGSFSGY

SEQ ID NO: 2966 - protein, 5 aa, Artificial Sequence
  Description of Artificial Sequence: Synthetic peptide
NHSGS

SEQ ID NO: 2967 - protein, 6 aa, Artificial Sequence
  Description of Artificial Sequence: Synthetic peptide
LINWFD

SEQ ID NO: 2968 - protein, 7 aa, Artificial Sequence
  Description of Artificial Sequence: Synthetic peptide
SQDISNW

SEQ ID NO: 2969 - protein, 3 aa, Artificial Sequence
  Description of Artificial Sequence: Synthetic peptide
AAS

SEQ ID NO: 2970 - protein, 6 aa, Artificial Sequence
  Description of Artificial Sequence: Synthetic peptide
ANSFPY

SEQ ID NO: 2971 - protein, 10 aa, Artificial Sequence
  Description of Artificial Sequence: Synthetic peptide
GGSFSGYYWS

SEQ ID NO: 2972 - protein, 9 aa, Artificial Sequence
  Description of Artificial Sequence: Synthetic peptide
EINHSGSTN

SEQ ID NO: 2973 - protein, 7 aa, Artificial Sequence
  Description of Artificial Sequence: Synthetic peptide
LINWFDP

SEQ ID NO: 2974 - protein, 11 aa, Artificial Sequence
  Description of Artificial Sequence: Synthetic peptide
RASQDISNWLA

SEQ ID NO: 2975 - protein, 7 aa, Artificial Sequence
  Description of Artificial Sequence: Synthetic peptide
AASSLQS

SEQ ID NO: 2976 - protein, 9 aa, Artificial Sequence
  Description of Artificial Sequence: Synthetic peptide
QQANSFPYT

SEQ ID NO: 2977 - protein, 6 aa, Artificial Sequence
  Description of Artificial Sequence: Synthetic peptide
SGYYWS

SEQ ID NO: 2978 - protein, 12 aa, Artificial Sequence
  Description of Artificial Sequence: Synthetic peptide
WIGEINHSGSTN

SEQ ID NO: 2979 - protein, 8 aa, Artificial Sequence
  Description of Artificial Sequence: Synthetic peptide
VRLINWFD

SEQ ID NO: 2980 - protein, 7 aa, Artificial Sequence
  Description of Artificial Sequence: Synthetic peptide
SNWLAWY

SEQ ID NO: 2981 - protein, 10 aa, Artificial Sequence
  Description of Artificial Sequence: Synthetic peptide
LLIFAASSLQ

SEQ ID NO: 2982 - protein, 8 aa, Artificial Sequence
  Description of Artificial Sequence: Synthetic peptide
QQANSFPY

SEQ ID NO: 2983 - protein, 8 aa, Artificial Sequence
  Description of Artificial Sequence: Synthetic peptide
GGSFSGYY

SEQ ID NO: 2984 - protein, 7 aa, Artificial Sequence
  Description of Artificial Sequence: Synthetic peptide
INHSGST

SEQ ID NO: 2985 - protein, 9 aa, Artificial Sequence
  Description of Artificial Sequence: Synthetic peptide
VRLINWFDP

SEQ ID NO: 2986 - protein, 6 aa, Artificial Sequence
  Description of Artificial Sequence: Synthetic peptide
QDISNW

SEQ ID NO: 2987 - protein, 3 aa, Artificial Sequence
  Description of Artificial Sequence: Synthetic peptide
AAS

SEQ ID NO: 2988 - protein, 9 aa, Artificial Sequence
  Description of Artificial Sequence: Synthetic peptide
QQANSFPYT

SEQ ID NO: 2989 - protein, 115 aa, Artificial Sequence
  Description of Artificial Sequence: Synthetic polypeptide
QVQLQQWGAGLLKPSETLSLTCAVYGGSFSGYYWSWIRQPPGKGLEWIGEINHSGSTNYNPSLKSRVTISVDTSENQFSLTLISVTAADTAVYYCVRLINWFDPWGQGTLVTVSS

SEQ ID NO: 2990 - protein, 107 aa, Artificial Sequence
  Description of Artificial Sequence: Synthetic polypeptide
DIQMTQSPSSVSASVGDRVTITCRASQDISNWLAWYQQKPGKAPKLLIFAASSLQSGVPSRFSGSGSGTDFTLTISSLQPDDFATYYCQQANSFPYTFGQGTNLGIK

SEQ ID NO: 2991 - protein, 445 aa, Artificial Sequence
  Description of Artificial Sequence: Synthetic peptide
QVQLQQWGAGLLKPSETLSLTCAVYGGSFSGYYWSWIRQPPGKGLEWIGEINHSGSTNYNPSLKSRVTISVDTSENQFSLTLISVTAADTAVYYCVRLINWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2992 - protein, 214 aa, Artificial Sequence
  Description of Artificial Sequence: Synthetic peptide
DIQMTQSPSSVSASVGDRVTITCRASQDISNWLAWYQQKPGKAPKLLIFAASSLQSGVPSRFSGSGSGTDFTLTISSLQPDDFATYYCQQANSFPYTFGQGTNLGIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2993 - protein, 5 aa, Artificial Sequence
  Description of Artificial Sequence: Synthetic peptide
NYGIH

SEQ ID NO: 2994 - protein, 17 aa, Artificial Sequence
  Description of Artificial Sequence: Synthetic peptide
IIWYDGSKKYYADSVKG

SEQ ID NO: 2995 - protein, 10 aa, Artificial Sequence
  Description of Artificial Sequence: Synthetic peptide
EDDWNDGLAY

SEQ ID NO: 2996 - protein, 11 aa, Artificial Sequence
  Description of Artificial Sequence: Synthetic peptide
RASQDIRNDLG

SEQ ID NO: 2997 - protein, 7 aa, Artificial Sequence
  Description of Artificial Sequence: Synthetic peptide
AASNLQS

SEQ ID NO: 2998 - protein, 9 aa, Artificial Sequence
  Description of Artificial Sequence: Synthetic peptide
LQDSNYPRT

SEQ ID NO: 2999 - protein, 7 aa, Artificial Sequence
  Description of Artificial Sequence: Synthetic peptide
GFNFINY

SEQ ID NO: 3000 - protein, 6 aa, Artificial Sequence
  Description of Artificial Sequence: Synthetic peptide
WYDGSK

SEQ ID NO: 3001 - protein, 9 aa, Artificial Sequence
  Description of Artificial Sequence: Synthetic peptide
EDDWNDGLA

SEQ ID NO: 3002 - protein, 7 aa, Artificial Sequence
  Description of Artificial Sequence: Synthetic peptide
SQDIRND

SEQ ID NO: 3003 - protein, 3 aa, Artificial Sequence
  Description of Artificial Sequence: Synthetic peptide
AAS

SEQ ID NO: 3004 - protein, 6 aa, Artificial Sequence
  Description of Artificial Sequence: Synthetic peptide
DSNYPR

SEQ ID NO: 3005 - protein, 10 aa, Artificial Sequence
  Description of Artificial Sequence: Synthetic peptide
GFNFINYGIH

SEQ ID NO: 3006 - protein, 10 aa, Artificial Sequence
  Description of Artificial Sequence: Synthetic peptide
IIWYDGSKKY

SEQ ID NO: 3007 - protein, 10 aa, Artificial Sequence
  Description of Artificial Sequence: Synthetic peptide
EDDWNDGLAY

SEQ ID NO: 3008 - protein, 11 aa, Artificial Sequence
  Description of Artificial Sequence: Synthetic peptide
RASQDIRNDLG

SEQ ID NO: 3009 - protein, 7 aa, Artificial Sequence
  Description of Artificial Sequence: Synthetic peptide
AASNLQS

SEQ ID NO: 3010 - protein, 9 aa, Artificial Sequence
  Description of Artificial Sequence: Synthetic peptide
LQDSNYPRT

SEQ ID NO: 3011 - protein, 6 aa, Artificial Sequence
  Description of Artificial Sequence: Synthetic peptide
INYGIH

SEQ ID NO: 3012 - protein, 13 aa, Artificial Sequence
  Description of Artificial Sequence: Synthetic peptide
WVTIIWYDGSKKY

SEQ ID NO: 3013 - protein, 11 aa, Artificial Sequence
  Description of Artificial Sequence: Synthetic peptide
AREDDWNDGLA

SEQ ID NO: 3014 - protein, 7 aa, Artificial Sequence
  Description of Artificial Sequence: Synthetic peptide
RNDLGWY

SEQ ID NO: 3015 - protein, 10 aa, Artificial Sequence
  Description of Artificial Sequence: Synthetic peptide
LLIYAASNLQ

SEQ ID NO: 3016 - protein, 8 aa, Artificial Sequence
  Description of Artificial Sequence: Synthetic peptide
LQDSNYPR

SEQ ID NO: 3017 - protein, 8 aa, Artificial Sequence
  Description of Artificial Sequence: Synthetic peptide
GFNFINYG

SEQ ID NO: 3018 - protein, 8 aa, Artificial Sequence
  Description of Artificial Sequence: Synthetic peptide
IWYDGSKK

SEQ ID NO: 3019 - protein, 12 aa, Artificial Sequence
  Description of Artificial Sequence: Synthetic peptide
AREDDWNDGLAY

SEQ ID NO: 3020 - protein, 6 aa, Artificial Sequence
  Description of Artificial Sequence: Synthetic peptide
QDIRND

SEQ ID NO: 3021 - protein, 3 aa, Artificial Sequence
  Description of Artificial Sequence: Synthetic peptide
AAS

SEQ ID NO: 3022 - protein, 9 aa, Artificial Sequence
  Description of Artificial Sequence: Synthetic peptide
LQDSNYPRT

SEQ ID NO: 3023 - protein, 119 aa, Artificial Sequence
  Description of Artificial Sequence: Synthetic polypeptide
QVQLVESGGGVVQPGRSLRLSCTASGFNFINYGIHWVRQAPGKGLEWVTIIWYDGSKKYYADSVKGRFAISRDNSKNTLYLQMNSLRAEDTAVYYCAREDDWNDGLAYWGQGTLVTVSS

SEQ ID NO: 3024 - protein, 107 aa, Artificial Sequence
  Description of Artificial Sequence: Synthetic polypeptide
AIQMTQSPSSLSASVGDRVTITCRASQDIRNDLGWYQQKPGKAPNLLIYAASNLQSGVPSRFSGSGSGTDFTLTISSLQPEDFATYYCLQDSNYPRTFGQGTKVEIK

SEQ ID NO: 3025 - protein, 449 aa, Artificial Sequence
  Description of Artificial Sequence: Synthetic peptide
QVQLVESGGGVVQPGRSLRLSCTASGFNFINYGIHWVRQAPGKGLEWVTIIWYDGSKKYYADSVKGRFAISRDNSKNTLYLQMNSLRAEDTAVYYCAREDDWNDGLAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3026 - protein, 214 aa, Artificial Sequence
  Description of Artificial Sequence: Synthetic peptide
AIQMTQSPSSLSASVGDRVTITCRASQDIRNDLGWYQQKPGKAPNLLIYAASNLQSGVPSRFSGSGSGTDFTLTISSLQPEDFATYYCLQDSNYPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3027 - protein, 5 aa, Artificial Sequence
  Description of Artificial Sequence: Synthetic peptide
DYYWS

SEQ ID NO: 3028 - protein, 16 aa, Artificial Sequence
  Description of Artificial Sequence: Synthetic peptide
RIYTSGSTNYNPSLKS

SEQ ID NO: 3029 - protein, 12 aa, Artificial Sequence
  Description of Artificial Sequence: Synthetic peptide
ELERYYFYGVDV

SEQ ID NO: 3030 - protein, 11 aa, Artificial Sequence
  Description of Artificial Sequence: Synthetic peptide
QASQDISNYLN

SEQ ID NO: 3031 - protein, 7 aa, Artificial Sequence
  Description of Artificial Sequence: Synthetic peptide
AASNLET

SEQ ID NO: 3032 - protein, 9 aa, Artificial Sequence
  Description of Artificial Sequence: Synthetic peptide
QQYDSLPLT

SEQ ID NO: 3033 - protein, 7 aa, Artificial Sequence
  Description of Artificial Sequence: Synthetic peptide
NGSISDY

SEQ ID NO: 3034 - protein, 5 aa, Artificial Sequence
  Description of Artificial Sequence: Synthetic peptide
YTSGS

SEQ ID NO: 3035 - protein, 11 aa, Artificial Sequence
  Description of Artificial Sequence: Synthetic peptide
ELERYYFYGVD

SEQ ID NO: 3036 - protein, 7 aa, Artificial Sequence
  Description of Artificial Sequence: Synthetic peptide
SQDISNY

SEQ ID NO: 3037 - protein, 3 aa, Artificial Sequence
  Description of Artificial Sequence: Synthetic peptide
AAS

SEQ ID NO: 3038 - protein, 6 aa, Artificial Sequence
  Description of Artificial Sequence: Synthetic peptide
YDSLPL

SEQ ID NO: 3039 - protein, 10 aa, Artificial Sequence
  Description of Artificial Sequence: Synthetic peptide
NGSISDYYWS

SEQ ID NO: 3040 - protein, 9 aa, Artificial Sequence
  Description of Artificial Sequence: Synthetic peptide
RIYTSGSTN

SEQ ID NO: 3041 - protein, 12 aa, Artificial Sequence
  Description of Artificial Sequence: Synthetic peptide
ELERYYFYGVDV

SEQ ID NO: 3042 - protein, 11 aa, Artificial Sequence
  Description of Artificial Sequence: Synthetic peptide
QASQDISNYLN

SEQ ID NO: 3043 - protein, 7 aa, Artificial Sequence
  Description of Artificial Sequence: Synthetic peptide
AASNLET

SEQ ID NO: 3044 - protein, 9 aa, Artificial Sequence
  Description of Artificial Sequence: Synthetic peptide
QQYDSLPLT

SEQ ID NO: 3045 - protein, 6 aa, Artificial Sequence
  Description of Artificial Sequence: Synthetic peptide
SDYYWS

SEQ ID NO: 3046 - protein, 12 aa, Artificial Sequence
  Description of Artificial Sequence: Synthetic peptide
WIGRIYTSGSTN

SEQ ID NO: 3047 - protein, 13 aa, Artificial Sequence
  Description of Artificial Sequence: Synthetic peptide
ARELERYYFYGVD

SEQ ID NO: 3048 - protein, 7 aa, Artificial Sequence
  Description of Artificial Sequence: Synthetic peptide
SNYLNWY

SEQ ID NO: 3049 - protein, 10 aa, Artificial Sequence
  Description of Artificial Sequence: Synthetic peptide
LLIYAASNLE

SEQ ID NO: 3050 - protein, 8 aa, Artificial Sequence
  Description of Artificial Sequence: Synthetic peptide
QQYDSLPL

SEQ ID NO: 3051 - protein, 8 aa, Artificial Sequence
  Description of Artificial Sequence: Synthetic peptide
NGSISDYY

SEQ ID NO: 3052 - protein, 7 aa, Artificial Sequence
  Description of Artificial Sequence: Synthetic peptide
IYTSGST

SEQ ID NO: 3053 - protein, 14 aa, Artificial Sequence
  Description of Artificial Sequence: Synthetic peptide
ARELERYYFYGVDV

SEQ ID NO: 3054 - protein, 6 aa, Artificial Sequence
  Description of Artificial Sequence: Synthetic peptide
QDISNY

SEQ ID NO: 3055 - protein, 3 aa, Artificial Sequence
  Description of Artificial Sequence: Synthetic peptide
AAS

SEQ ID NO: 3056 - protein, 9 aa, Artificial Sequence
  Description of Artificial Sequence: Synthetic peptide
QQYDSLPLT

SEQ ID NO: 3057 - protein, 120 aa, Artificial Sequence
  Description of Artificial Sequence: Synthetic polypeptide
QVQLQESGPGLVKPSETLSLTCTVSNGSISDYYWSWIRQPAGKGLEWIGRIYTSGSTNYNPSLKSRITMSVDTSKNQFSLELSSVTAADTAVYYCARELERYYFYGVDVWGQGTTVTVSS

SEQ ID NO: 3058 - protein, 107 aa, Artificial Sequence
  Description of Artificial Sequence: Synthetic polypeptide
DIQMTQSPSSLSASVGDRVTITCQASQDISNYLNWYQQKPGKAPKLLIYAASNLETGVPSRFSGSGSGTDFTFTISSLQPEDIATYYCQQYDSLPLTFGGGTKVEIK

SEQ ID NO: 3059-3060 - skipped (2 entries)

SEQ ID NO: 3061 - protein, 5 aa, Artificial Sequence
  Description of Artificial Sequence: Synthetic peptide
SYDIH

SEQ ID NO: 3062 - protein, 16 aa, Artificial Sequence
  Description of Artificial Sequence: Synthetic peptide
TIGTAGDTYYPGSVKG

SEQ ID NO: 3063 - protein, 10 aa, Artificial Sequence
  Description of Artificial Sequence: Synthetic peptide
GGYYYYGMDV

SEQ ID NO: 3064 - protein, 12 aa, Artificial Sequence
  Description of Artificial Sequence: Synthetic peptide
RASQSVYSSYLA

SEQ ID NO: 3065 - protein, 7 aa, Artificial Sequence
  Description of Artificial Sequence: Synthetic peptide
GASSRAT

SEQ ID NO: 3066 - protein, 9 aa, Artificial Sequence
  Description of Artificial Sequence: Synthetic peptide
QQFGTSPFT

SEQ ID NO: 3067 - protein, 7 aa, Artificial Sequence
  Description of Artificial Sequence: Synthetic peptide
GFTFSSY

SEQ ID NO: 3068 - protein, 5 aa, Artificial Sequence
  Description of Artificial Sequence: Synthetic peptide
GTAGD

SEQ ID NO: 3069 - protein, 9 aa, Artificial Sequence
  Description of Artificial Sequence: Synthetic peptide
GGYYYYGMD

SEQ ID NO: 3070 - protein, 8 aa, Artificial Sequence
  Description of Artificial Sequence: Synthetic peptide
SQSVYSSY

SEQ ID NO: 3071 - protein, 3 aa, Artificial Sequence
  Description of Artificial Sequence: Synthetic peptide
GAS

SEQ ID NO: 3072 - protein, 6 aa, Artificial Sequence
  Description of Artificial Sequence: Synthetic peptide
FGTSPF

SEQ ID NO: 3073 - protein, 10 aa, Artificial Sequence
  Description of Artificial Sequence: Synthetic peptide
GFTFSSYDIH

SEQ ID NO: 3074 - protein, 9 aa, Artificial Sequence
  Description of Artificial Sequence: Synthetic peptide
TIGTAGDTY

SEQ ID NO: 3075 - protein, 10 aa, Artificial Sequence
  Description of Artificial Sequence: Synthetic peptide
GGYYYYGMDV

SEQ ID NO: 3076 - protein, 12 aa, Artificial Sequence
  Description of Artificial Sequence: Synthetic peptide
RASQSVYSSYLA

SEQ ID NO: 3077 - protein, 7 aa, Artificial Sequence
  Description of Artificial Sequence: Synthetic peptide
GASSRAT

SEQ ID NO: 3078 - protein, 9 aa, Artificial Sequence
  Description of Artificial Sequence: Synthetic peptide
QQFGTSPFT

SEQ ID NO: 3079 - protein, 6 aa, Artificial Sequence
  Description of Artificial Sequence: Synthetic peptide
SSYDIH

SEQ ID NO: 3080 - protein, 12 aa, Artificial Sequence
  Description of Artificial Sequence: Synthetic peptide
WVSTIGTAGDTY

SEQ ID NO: 3081 - protein, 11 aa, Artificial Sequence
  Description of Artificial Sequence: Synthetic peptide
ARGGYYYYGMD

SEQ ID NO: 3082 - protein, 8 aa, Artificial Sequence
  Description of Artificial Sequence: Synthetic peptide
YSSYLAWY

SEQ ID NO: 3083 - protein, 10 aa, Artificial Sequence
  Description of Artificial Sequence: Synthetic peptide
LLIYGASSRA

SEQ ID NO: 3084 - protein, 8 aa, Artificial Sequence
  Description of Artificial Sequence: Synthetic peptide
QQFGTSPF

SEQ ID NO: 3085 - protein, 8 aa, Artificial Sequence
  Description of Artificial Sequence: Synthetic peptide
GFTFSSYD

SEQ ID NO: 3086 - protein, 7 aa, Artificial Sequence
  Description of Artificial Sequence: Synthetic peptide
IGTAGDT

SEQ ID NO: 3087 - protein, 12 aa, Artificial Sequence
  Description of Artificial Sequence: Synthetic peptide
ARGGYYYYGMDV

SEQ ID NO: 3088 - protein, 7 aa, Artificial Sequence
  Description of Artificial Sequence: Synthetic peptide
QSVYSSY

SEQ ID NO: 3089 - protein, 3 aa, Artificial Sequence
  Description of Artificial Sequence: Synthetic peptide
GAS

SEQ ID NO: 3090 - protein, 9 aa, Artificial Sequence
  Description of Artificial Sequence: Synthetic peptide
QQFGTSPFT

SEQ ID NO: 3091 - protein, 118 aa, Artificial Sequence
  Description of Artificial Sequence: Synthetic polypeptide
EVQLVESGGGLVQPGGSLRLSCAASGFTFSSYDIHWVRQATGKGLEWVSTIGTAGDTYYPGSVKGRFTISRENAKNSLYLQMNSLRAGDTAVYYCARGGYYYYGMDVWGQGTTVTVSS

SEQ ID NO: 3092 - protein, 108 aa, Artificial Sequence
  Description of Artificial Sequence: Synthetic polypeptide
EIVLTQSPGTLSLSPGERATLSCRASQSVYSSYLAWYQQKPGQAPRLLIYGASSRATGIPDRFSGSGSGTDFTLTISRLEPEDFAVYYCQQFGTSPFTFGPGTKVDIK

SEQ ID NO: 3093 - protein, 448 aa, Artificial Sequence
  Description of Artificial Sequence: Synthetic peptide
EVQLVESGGGLVQPGGSLRLSCAASGFTFSSYDIHWVRQATGKGLEWVSTIGTAGDTYYPGSVKGRFTISRENAKNSLYLQMNSLRAGDTAVYYCARGGYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3094 - protein, 215 aa, Artificial Sequence
  Description of Artificial Sequence: Synthetic peptide
EIVLTQSPGTLSLSPGERATLSCRASQSVYSSYLAWYQQKPGQAPRLLIYGASSRATGIPDRFSGSGSGTDFTLTISRLEPEDFAVYYCQQFGTSPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3095 - protein, 5 aa, Artificial Sequence
  Description of Artificial Sequence: Synthetic peptide
NAWMS

SEQ ID NO: 3096 - protein, 19 aa, Artificial Sequence
  Description of Artificial Sequence: Synthetic peptide
RIKSKTDGGTTDYAAPVKG

SEQ ID NO: 3097 - protein, 13 aa, Artificial Sequence
  Description of Artificial Sequence: Synthetic peptide
GGWFGELWGPFDI

SEQ ID NO: 3098 - protein, 17 aa, Artificial Sequence
  Description of Artificial Sequence: Synthetic peptide
KSSQSVLYSSNNKNYLA

SEQ ID NO: 3099 - protein, 7 aa, Artificial Sequence
  Description of Artificial Sequence: Synthetic peptide
WASARES

SEQ ID NO: 3100 - protein, 9 aa, Artificial Sequence
  Description of Artificial Sequence: Synthetic peptide
QQYFGSFPT

SEQ ID NO: 3101 - protein, 7 aa, Artificial Sequence
  Description of Artificial Sequence: Synthetic peptide
GFTFSNA

SEQ ID NO: 3102 - protein, 8 aa, Artificial Sequence
  Description of Artificial Sequence: Synthetic peptide
KSKTDGGT

SEQ ID NO: 3103 - protein, 12 aa, Artificial Sequence
  Description of Artificial Sequence: Synthetic peptide
GGWFGELWGPFD

SEQ ID NO: 3104 - protein, 13 aa, Artificial Sequence
  Description of Artificial Sequence: Synthetic peptide
SQSVLYSSNNKNY

SEQ ID NO: 3105 - protein, 3 aa, Artificial Sequence
  Description of Artificial Sequence: Synthetic peptide
WAS

SEQ ID NO: 3106 - protein, 6 aa, Artificial Sequence
  Description of Artificial Sequence: Synthetic peptide
YFGSFP

SEQ ID NO: 3107 - protein, 10 aa, Artificial Sequence
  Description of Artificial Sequence: Synthetic peptide
GFTFSNAWMS

SEQ ID NO: 3108 - protein, 12 aa, Artificial Sequence
  Description of Artificial Sequence: Synthetic peptide
RIKSKTDGGTTD

SEQ ID NO: 3109 - protein, 13 aa, Artificial Sequence
  Description of Artificial Sequence: Synthetic peptide
GGWFGELWGPFDI

SEQ ID NO: 3110 - protein, 17 aa, Artificial Sequence
  Description of Artificial Sequence: Synthetic peptide
KSSQSVLYSSNNKNYLA

SEQ ID NO: 3111 - protein, 7 aa, Artificial Sequence
  Description of Artificial Sequence: Synthetic peptide
WASARES

SEQ ID NO: 3112 - protein, 9 aa, Artificial Sequence
  Description of Artificial Sequence: Synthetic peptide
QQYFGSFPT

SEQ ID NO: 3113 - protein, 6 aa, Artificial Sequence
  Description of Artificial Sequence: Synthetic peptide
SNAWMS

SEQ ID NO: 3114 - protein, 15 aa, Artificial Sequence
  Description of Artificial Sequence: Synthetic peptide
WVGRIKSKTDGGTTD

SEQ ID NO: 3115 - protein, 14 aa, Artificial Sequence
  Description of Artificial Sequence: Synthetic peptide
TTGGWFGELWGPFD

SEQ ID NO: 3116 - protein, 13 aa, Artificial Sequence
  Description of Artificial Sequence: Synthetic peptide
LYSSNNKNYLAWY

SEQ ID NO: 3117 - protein, 10 aa, Artificial Sequence
  Description of Artificial Sequence: Synthetic peptide
LLFYWASARE

SEQ ID NO: 3118 - protein, 8 aa, Artificial Sequence
  Description of Artificial Sequence: Synthetic peptide
QQYFGSFP

SEQ ID NO: 3119 - protein, 8 aa, Artificial Sequence
  Description of Artificial Sequence: Synthetic peptide
GFTFSNAW

SEQ ID NO: 3120 - protein, 10 aa, Artificial Sequence
  Description of Artificial Sequence: Synthetic peptide
IKSKTDGGTT

SEQ ID NO: 3121 - protein, 15 aa, Artificial Sequence
  Description of Artificial Sequence: Synthetic peptide
TTGGWFGELWGPFDI

SEQ ID NO: 3122 - protein, 12 aa, Artificial Sequence
  Description of Artificial Sequence: Synthetic peptide
QSVLYSSNNKNY

SEQ ID NO: 3123 - protein, 3 aa, Artificial Sequence
  Description of Artificial Sequence: Synthetic peptide
WAS

SEQ ID NO: 3124 - protein, 9 aa, Artificial Sequence
  Description of Artificial Sequence: Synthetic peptide
QQYFGSFPT

SEQ ID NO: 3125 - protein, 124 aa, Artificial Sequence
  Description of Artificial Sequence: Synthetic polypeptide
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTGGWFGELWGPFDIWGQGTMVTVSS

SEQ ID NO: 3126 - protein, 113 aa, Artificial Sequence
  Description of Artificial Sequence: Synthetic polypeptide
DIVMTQSPDSLAVSLGERATINCKSSQSVLYSSNNKNYLAWYQQKPGQPPKLLFYWASARESGVPDRFSGSGSGTDFTLTISSLQAEDVALYYCQQYFGSFPTFGQGTKLEIK

SEQ ID NO: 3127-3128 - skipped (2 entries)

SEQ ID NO: 3129 - protein, 7 aa, Artificial Sequence
  Description of Artificial Sequence: Synthetic peptide
SGYYYWS

SEQ ID NO: 3130 - protein, 16 aa, Artificial Sequence
  Description of Artificial Sequence: Synthetic peptide
YISYSGSTYYNPSLKS

SEQ ID NO: 3131 - protein, 11 aa, Artificial Sequence
  Description of Artificial Sequence: Synthetic peptide
DRPSNFDAFDI

SEQ ID NO: 3132 - protein, 12 aa, Artificial Sequence
  Description of Artificial Sequence: Synthetic peptide
RASQSVGSTYLA

SEQ ID NO: 3133 - protein, 7 aa, Artificial Sequence
  Description of Artificial Sequence: Synthetic peptide
GAFSRAT

SEQ ID NO: 3134 - protein, 9 aa, Artificial Sequence
  Description of Artificial Sequence: Synthetic peptide
QQYGSSPLT

SEQ ID NO: 3135 - protein, 9 aa, Artificial Sequence
  Description of Artificial Sequence: Synthetic peptide
GDSISSGYY

SEQ ID NO: 3136 - protein, 5 aa, Artificial Sequence
  Description of Artificial Sequence: Synthetic peptide
SYSGS

SEQ ID NO: 3137 - protein, 10 aa, Artificial Sequence
  Description of Artificial Sequence: Synthetic peptide
DRPSNFDAFD

SEQ ID NO: 3138 - protein, 8 aa, Artificial Sequence
  Description of Artificial Sequence: Synthetic peptide
SQSVGSTY

SEQ ID NO: 3139 - protein, 3 aa, Artificial Sequence
  Description of Artificial Sequence: Synthetic peptide
GAF

SEQ ID NO: 3140 - protein, 6 aa, Artificial Sequence
  Description of Artificial Sequence: Synthetic peptide
YGSSPL

SEQ ID NO: 3141 - protein, 12 aa, Artificial Sequence
  Description of Artificial Sequence: Synthetic peptide
GDSISSGYYYWS

SEQ ID NO: 3142 - protein, 9 aa, Artificial Sequence
  Description of Artificial Sequence: Synthetic peptide
YISYSGSTY

SEQ ID NO: 3143 - protein, 11 aa, Artificial Sequence
  Description of Artificial Sequence: Synthetic peptide
DRPSNFDAFDI

SEQ ID NO: 3144 - protein, 12 aa, Artificial Sequence
  Description of Artificial Sequence: Synthetic peptide
RASQSVGSTYLA

SEQ ID NO: 3145 - protein, 7 aa, Artificial Sequence
  Description of Artificial Sequence: Synthetic peptide
GAFSRAT

SEQ ID NO: 3146 - protein, 9 aa, Artificial Sequence
  Description of Artificial Sequence: Synthetic peptide
QQYGSSPLT

SEQ ID NO: 3147 - protein, 8 aa, Artificial Sequence
  Description of Artificial Sequence: Synthetic peptide
SSGYYYWS

SEQ ID NO: 3148 - protein, 12 aa, Artificial Sequence
  Description of Artificial Sequence: Synthetic peptide
WIGYISYSGSTY

SEQ ID NO: 3149 - protein, 12 aa, Artificial Sequence
  Description of Artificial Sequence: Synthetic peptide
ARDRPSNFDAFD

SEQ ID NO: 3150 - protein, 8 aa, Artificial Sequence
  Description of Artificial Sequence: Synthetic peptide
GSTYLAWY

SEQ ID NO: 3151 - protein, 10 aa, Artificial Sequence
  Description of Artificial Sequence: Synthetic peptide
LLIYGAFSRA

SEQ ID NO: 3152 - protein, 8 aa, Artificial Sequence
  Description of Artificial Sequence: Synthetic peptide
QQYGSSPL

SEQ ID NO: 3153 - protein, 10 aa, Artificial Sequence
  Description of Artificial Sequence: Synthetic peptide
GDSISSGYYY

SEQ ID NO: 3154 - protein, 7 aa, Artificial Sequence
  Description of Artificial Sequence: Synthetic peptide
ISYSGST

SEQ ID NO: 3155 - protein, 13 aa, Artificial Sequence
  Description of Artificial Sequence: Synthetic peptide
ARDRPSNFDAFDI

SEQ ID NO: 3156 - protein, 7 aa, Artificial Sequence
  Description of Artificial Sequence: Synthetic peptide
QSVGSTY

SEQ ID NO: 3157 - protein, 3 aa, Artificial Sequence
  Description of Artificial Sequence: Synthetic peptide
GAF

SEQ ID NO: 3158 - protein, 9 aa, Artificial Sequence
  Description of Artificial Sequence: Synthetic peptide
QQYGSSPLT

SEQ ID NO: 3159 - protein, 121 aa, Artificial Sequence
  Description of Artificial Sequence: Synthetic polypeptide
QVQLQESGPGLVKPSQTLSLTCTVSGDSISSGYYYWSWIRQHPGKGLEWIGYISYSGSTYYNPSLKSRLTISVNTSKNQFSLKLSSLTAADTAVYYCARDRPSNFDAFDIWGQGTMVTVSS

SEQ ID NO: 3160 - protein, 108 aa, Artificial Sequence
  Description of Artificial Sequence: Synthetic polypeptide
EIVLTQSPGTLSLSPGERATLSCRASQSVGSTYLAWYQQKPGQAPRLLIYGAFSRATGIPDRFSGSGSGTDFTLTISRLEPEDFAVYYCQQYGSSPLTFGPGTKVDIK

SEQ ID NO: 3161 - protein, 451 aa, Artificial Sequence
  Description of Artificial Sequence: Synthetic peptide
QVQLQESGPGLVKPSQTLSLTCTVSGDSISSGYYYWSWIRQHPGKGLEWIGYISYSGSTYYNPSLKSRLTISVNTSKNQFSLKLSSLTAADTAVYYCARDRPSNFDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3162 - protein, 215 aa, Artificial Sequence
  Description of Artificial Sequence: Synthetic peptide
EIVLTQSPGTLSLSPGERATLSCRASQSVGSTYLAWYQQKPGQAPRLLIYGAFSRATGIPDRFSGSGSGTDFTLTISRLEPEDFAVYYCQQYGSSPLTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3163 - protein, 5 aa, Artificial Sequence
  Description of Artificial Sequence: Synthetic peptide
TYYWS

SEQ ID NO: 3164 - protein, 16 aa, Artificial Sequence
  Description of Artificial Sequence: Synthetic peptide
RIYTSERPNYNPSLKS

SEQ ID NO: 3165 - protein, 12 aa, Artificial Sequence
  Description of Artificial Sequence: Synthetic peptide
ELERPYYYGMDV

SEQ ID NO: 3166 - protein, 11 aa, Artificial Sequence
  Description of Artificial Sequence: Synthetic peptide
QASQDISNYLN

SEQ ID NO: 3167 - protein, 7 aa, Artificial Sequence
  Description of Artificial Sequence: Synthetic peptide
YASNLET

SEQ ID NO: 3168 - protein, 9 aa, Artificial Sequence
  Description of Artificial Sequence: Synthetic peptide
QQYDNLPLT

SEQ ID NO: 3169 - protein, 7 aa, Artificial Sequence
  Description of Artificial Sequence: Synthetic peptide
GGSISTY

SEQ ID NO: 3170 - protein, 5 aa, Artificial Sequence
  Description of Artificial Sequence: Synthetic peptide
YTSER

SEQ ID NO: 3171 - protein, 11 aa, Artificial Sequence
  Description of Artificial Sequence: Synthetic peptide
ELERPYYYGMD

SEQ ID NO: 3172 - protein, 7 aa, Artificial Sequence
  Description of Artificial Sequence: Synthetic peptide
SQDISNY

SEQ ID NO: 3173 - protein, 3 aa, Artificial Sequence
  Description of Artificial Sequence: Synthetic peptide
YAS

SEQ ID NO: 3174 - protein, 6 aa, Artificial Sequence
  Description of Artificial Sequence: Synthetic peptide
YDNLPL

SEQ ID NO: 3175 - protein, 10 aa, Artificial Sequence
  Description of Artificial Sequence: Synthetic peptide
GGSISTYYWS

SEQ ID NO: 3176 - protein, 9 aa, Artificial Sequence
  Description of Artificial Sequence: Synthetic peptide
RIYTSERPN

SEQ ID NO: 3177 - protein, 12 aa, Artificial Sequence
  Description of Artificial Sequence: Synthetic peptide
ELERPYYYGMDV

SEQ ID NO: 3178 - protein, 11 aa, Artificial Sequence
  Description of Artificial Sequence: Synthetic peptide
QASQDISNYLN

SEQ ID NO: 3179 - protein, 7 aa, Artificial Sequence
  Description of Artificial Sequence: Synthetic peptide
YASNLET

SEQ ID NO: 3180 - protein, 9 aa, Artificial Sequence
  Description of Artificial Sequence: Synthetic peptide
QQYDNLPLT

SEQ ID NO: 3181 - protein, 6 aa, Artificial Sequence
  Description of Artificial Sequence: Synthetic peptide
STYYWS

SEQ ID NO: 3182 - protein, 12 aa, Artificial Sequence
  Description of Artificial Sequence: Synthetic peptide
WIGRIYTSERPN

SEQ ID NO: 3183 - protein, 13 aa, Artificial Sequence
  Description of Artificial Sequence: Synthetic peptide
ARELERPYYYGMD

SEQ ID NO: 3184 - protein, 7 aa, Artificial Sequence
  Description of Artificial Sequence: Synthetic peptide
SNYLNWY

SEQ ID NO: 3185 - protein, 10 aa, Artificial Sequence
  Description of Artificial Sequence: Synthetic peptide
LLIYYASNLE

SEQ ID NO: 3186 - protein, 8 aa, Artificial Sequence
  Description of Artificial Sequence: Synthetic peptide
QQYDNLPL

SEQ ID NO: 3187 - protein, 8 aa, Artificial Sequence
  Description of Artificial Sequence: Synthetic peptide
GGSISTYY

SEQ ID NO: 3188 - protein, 7 aa, Artificial Sequence
  Description of Artificial Sequence: Synthetic peptide
IYTSERP

SEQ ID NO: 3189 - protein, 14 aa, Artificial Sequence
  Description of Artificial Sequence: Synthetic peptide
ARELERPYYYGMDV

SEQ ID NO: 3190 - protein, 6 aa, Artificial Sequence
  Description of Artificial Sequence: Synthetic peptide
QDISNY

SEQ ID NO: 3191 - protein, 3 aa, Artificial Sequence
  Description of Artificial Sequence: Synthetic peptide
YAS

SEQ ID NO: 3192 - protein, 9 aa, Artificial Sequence
  Description of Artificial Sequence: Synthetic peptide
QQYDNLPLT

SEQ ID NO: 3193 - protein, 120 aa, Artificial Sequence
  Description of Artificial Sequence: Synthetic polypeptide
QVQLQESGPGLVKPSETLSLTCTVSGGSISTYYWSWIRQSAGKGLEWIGRIYTSERPNYNPSLKSRVTMSVDTSKNQFSLKLNSVSAADTAVYYCARELERPYYYGMDVWGQGTTVTVSS

SEQ ID NO: 3194 - protein, 107 aa, Artificial Sequence
  Description of Artificial Sequence: Synthetic polypeptide
DVQMTQSPSSLSASVGGRVTITCQASQDISNYLNWYQQKPGKAPKLLIYYASNLETGVPSRFSGSGSGTDFTFTISSLQPEDFATYYCQQYDNLPLTFGGGTKVEIK

SEQ ID NO: 3195-3196 - skipped (2 entries)

SEQ ID NO: 3197 - protein, 5 aa, Artificial Sequence
  Description of Artificial Sequence: Synthetic peptide
SYWMS

SEQ ID NO: 3198 - protein, 17 aa, Artificial Sequence
  Description of Artificial Sequence: Synthetic peptide
NINQDGSEKYYVDSVKG

SEQ ID NO: 3199 - protein, 10 aa, Artificial Sequence
  Description of Artificial Sequence: Synthetic peptide
EGGQWLSLDY

SEQ ID NO: 3200 - protein, 11 aa, Artificial Sequence
  Description of Artificial Sequence: Synthetic peptide
RASQGISSWLA

SEQ ID NO: 3201 - protein, 7 aa, Artificial Sequence
  Description of Artificial Sequence: Synthetic peptide
GVSSFQS

SEQ ID NO: 3202 - protein, 9 aa, Artificial Sequence
  Description of Artificial Sequence: Synthetic peptide
QQANSFPWT

SEQ ID NO: 3203 - protein, 7 aa, Artificial Sequence
  Description of Artificial Sequence: Synthetic peptide
GFTFSSY

SEQ ID NO: 3204 - protein, 6 aa, Artificial Sequence
  Description of Artificial Sequence: Synthetic peptide
NQDGSE

SEQ ID NO: 3205 - protein, 9 aa, Artificial Sequence
  Description of Artificial Sequence: Synthetic peptide
EGGQWLSLD

SEQ ID NO: 3206 - protein, 7 aa, Artificial Sequence
  Description of Artificial Sequence: Synthetic peptide
SQGISSW

SEQ ID NO: 3207 - protein, 3 aa, Artificial Sequence
  Description of Artificial Sequence: Synthetic peptide
GVS

SEQ ID NO: 3208 - protein, 6 aa, Artificial Sequence
  Description of Artificial Sequence: Synthetic peptide
ANSFPW

SEQ ID NO: 3209 - protein, 10 aa, Artificial Sequence
  Description of Artificial Sequence: Synthetic peptide
GFTFSSYWMS

SEQ ID NO: 3210 - protein, 10 aa, Artificial Sequence
  Description of Artificial Sequence: Synthetic peptide
NINQDGSEKY

SEQ ID NO: 3211 - protein, 10 aa, Artificial Sequence
  Description of Artificial Sequence: Synthetic peptide
EGGQWLSLDY

SEQ ID NO: 3212 - protein, 11 aa, Artificial Sequence
  Description of Artificial Sequence: Synthetic peptide
RASQGISSWLA

SEQ ID NO: 3213 - protein, 7 aa, Artificial Sequence
  Description of Artificial Sequence: Synthetic peptide
GVSSFQS

SEQ ID NO: 3214 - protein, 9 aa, Artificial Sequence
  Description of Artificial Sequence: Synthetic peptide
QQANSFPWT

SEQ ID NO: 3215 - protein, 6 aa, Artificial Sequence
  Description of Artificial Sequence: Synthetic peptide
SSYWMS

SEQ ID NO: 3216 - protein, 13 aa, Artificial Sequence
  Description of Artificial Sequence: Synthetic peptide
WVANINQDGSEKY

SEQ ID NO: 3217 - protein, 11 aa, Artificial Sequence
  Description of Artificial Sequence: Synthetic peptide
AREGGQWLSLD

SEQ ID NO: 3218 - protein, 7 aa, Artificial Sequence
  Description of Artificial Sequence: Synthetic peptide
SSWLAWY

SEQ ID NO: 3219 - protein, 10 aa, Artificial Sequence
  Description of Artificial Sequence: Synthetic peptide
VLIYGVSSFQ

SEQ ID NO: 3220 - protein, 8 aa, Artificial Sequence
  Description of Artificial Sequence: Synthetic peptide
QQANSFPW

SEQ ID NO: 3221 - protein, 8 aa, Artificial Sequence
  Description of Artificial Sequence: Synthetic peptide
GFTFSSYW

SEQ ID NO: 3222 - protein, 8 aa, Artificial Sequence
  Description of Artificial Sequence: Synthetic peptide
INQDGSEK

SEQ ID NO: 3223 - protein, 12 aa, Artificial Sequence
  Description of Artificial Sequence: Synthetic peptide
AREGGQWLSLDY

SEQ ID NO: 3224 - protein, 6 aa, Artificial Sequence
  Description of Artificial Sequence: Synthetic peptide
QGISSW

SEQ ID NO: 3225 - protein, 3 aa, Artificial Sequence
  Description of Artificial Sequence: Synthetic peptide
GVS

SEQ ID NO: 3226 - protein, 9 aa, Artificial Sequence
  Description of Artificial Sequence: Synthetic peptide
QQANSFPWT

SEQ ID NO: 3227 - protein, 119 aa, Artificial Sequence
  Description of Artificial Sequence: Synthetic polypeptide
EVQLVESGGGLVQPGGSLRLSCAASGFTFSSYWMSWVRQAPGKGLEWVANINQDGSEKYYVDSVKGRFTISRDNAKNSLYLQLNSLRAEDTAMYYCAREGGQWLSLDYWGQGTLVTVSS

SEQ ID NO: 3228 - protein, 107 aa, Artificial Sequence
  Description of Artificial Sequence: Synthetic polypeptide
DIQMTQSPSSVSASVGDRVTITCRASQGISSWLAWYQQKPGKAPKVLIYGVSSFQSGVPSRFSGSGSGTDFILTISSLQPEDFATYYCQQANSFPWTFGQGTKVEIK

SEQ ID NO: 3229-3230 - skipped (2 entries)

SEQ ID NO: 3231 - protein, 5 aa, Artificial Sequence
  Description of Artificial Sequence: Synthetic peptide
NYDMH

SEQ ID NO: 3232 - protein, 16 aa, Artificial Sequence
  Description of Artificial Sequence: Synthetic peptide
TIGTAGDTYYPGSVKG

SEQ ID NO: 3233 - protein, 10 aa, Artificial Sequence
  Description of Artificial Sequence: Synthetic peptide
GGDYYYGMDV

SEQ ID NO: 3234 - protein, 12 aa, Artificial Sequence
  Description of Artificial Sequence: Synthetic peptide
RASQSLSSVYLA

SEQ ID NO: 3235 - protein, 7 aa, Artificial Sequence
  Description of Artificial Sequence: Synthetic peptide
GASSRAT

SEQ ID NO: 3236 - protein, 9 aa, Artificial Sequence
  Description of Artificial Sequence: Synthetic peptide
QQYGSSPFT

SEQ ID NO: 3237 - protein, 7 aa, Artificial Sequence
  Description of Artificial Sequence: Synthetic peptide
GFTFSNY

SEQ ID NO: 3238 - protein, 5 aa, Artificial Sequence
  Description of Artificial Sequence: Synthetic peptide
GTAGD

SEQ ID NO: 3239 - protein, 9 aa, Artificial Sequence
  Description of Artificial Sequence: Synthetic peptide
GGDYYYGMD

SEQ ID NO: 3240 - protein, 8 aa, Artificial Sequence
  Description of Artificial Sequence: Synthetic peptide
SQSLSSVY

SEQ ID NO: 3241 - protein, 3 aa, Artificial Sequence
  Description of Artificial Sequence: Synthetic peptide
GAS

SEQ ID NO: 3242 - protein, 6 aa, Artificial Sequence
  Description of Artificial Sequence: Synthetic peptide
YGSSPF

SEQ ID NO: 3243 - protein, 10 aa, Artificial Sequence
  Description of Artificial Sequence: Synthetic peptide
GFTFSNYDMH

SEQ ID NO: 3244 - protein, 9 aa, Artificial Sequence
  Description of Artificial Sequence: Synthetic peptide
TIGTAGDTY

SEQ ID NO: 3245 - protein, 10 aa, Artificial Sequence
  Description of Artificial Sequence: Synthetic peptide
GGDYYYGMDV

SEQ ID NO: 3246 - protein, 12 aa, Artificial Sequence
  Description of Artificial Sequence: Synthetic peptide
RASQSLSSVYLA

SEQ ID NO: 3247 - protein, 7 aa, Artificial Sequence
  Description of Artificial Sequence: Synthetic peptide
GASSRAT

SEQ ID NO: 3248 - protein, 9 aa, Artificial Sequence
  Description of Artificial Sequence: Synthetic peptide
QQYGSSPFT

SEQ ID NO: 3249 - protein, 6 aa, Artificial Sequence
  Description of Artificial Sequence: Synthetic peptide
SNYDMH

SEQ ID NO: 3250 - protein, 12 aa, Artificial Sequence
  Description of Artificial Sequence: Synthetic peptide
WVSTIGTAGDTY

SEQ ID NO: 3251 - protein, 11 aa, Artificial Sequence
  Description of Artificial Sequence: Synthetic peptide
ARGGDYYYGMD

SEQ ID NO: 3252 - protein, 8 aa, Artificial Sequence
  Description of Artificial Sequence: Synthetic peptide
SSVYLAWY

SEQ ID NO: 3253 - protein, 10 aa, Artificial Sequence
  Description of Artificial Sequence: Synthetic peptide
LLIYGASSRA

SEQ ID NO: 3254 - protein, 8 aa, Artificial Sequence
  Description of Artificial Sequence: Synthetic peptide
QQYGSSPF

SEQ ID NO: 3255 - protein, 8 aa, Artificial Sequence
  Description of Artificial Sequence: Synthetic peptide
GFTFSNYD

SEQ ID NO: 3256 - protein, 7 aa, Artificial Sequence
  Description of Artificial Sequence: Synthetic peptide
IGTAGDT

SEQ ID NO: 3257 - protein, 12 aa, Artificial Sequence
  Description of Artificial Sequence: Synthetic peptide
ARGGDYYYGMDV

SEQ ID NO: 3258 - protein, 7 aa, Artificial Sequence
  Description of Artificial Sequence: Synthetic peptide
QSLSSVY

SEQ ID NO: 3259 - protein, 3 aa, Artificial Sequence
  Description of Artificial Sequence: Synthetic peptide
GAS

SEQ ID NO: 3260 - protein, 9 aa, Artificial Sequence
  Description of Artificial Sequence: Synthetic peptide
QQYGSSPFT

SEQ ID NO: 3261 - protein, 118 aa, Artificial Sequence
  Description of Artificial Sequence: Synthetic polypeptide
EVQLVESGGGLVQPGGSLRLSCAASGFTFSNYDMHWVRQATGKGLEWVSTIGTAGDTYYPGSVKGRFTISRENAKNSLYLQMNSLRAGDTAVYYCARGGDYYYGMDVWGQGTTVTVSS

SEQ ID NO: 3262 - protein, 108 aa, Artificial Sequence
  Description of Artificial Sequence: Synthetic polypeptide
EIVLTQSPDTLSLSPGERATLSCRASQSLSSVYLAWYQQKPGQAPRLLIYGASSRATGIPDRFSGSGSGTDFTLTINRLEPEDFVVYYCQQYGSSPFTFGPGTKVDIK

SEQ ID NO: 3263-3264 - skipped (2 entries)

SEQ ID NO: 3265 - protein, 5 aa, Artificial Sequence
  Description of Artificial Sequence: Synthetic peptide
GYYWS

SEQ ID NO: 3266 - protein, 16 aa, Artificial Sequence
  Description of Artificial Sequence: Synthetic peptide
EINQSGSTNYNPSLKS

SEQ ID NO: 3267 - protein, 7 aa, Artificial Sequence
  Description of Artificial Sequence: Synthetic peptide
VLNWFDP

SEQ ID NO: 3268 - protein, 11 aa, Artificial Sequence
  Description of Artificial Sequence: Synthetic peptide
RASQDISNWLA

SEQ ID NO: 3269 - protein, 7 aa, Artificial Sequence
  Description of Artificial Sequence: Synthetic peptide
AASSLQS

SEQ ID NO: 3270 - protein, 9 aa, Artificial Sequence
  Description of Artificial Sequence: Synthetic peptide
QQANSFPYT

SEQ ID NO: 3271 - protein, 7 aa, Artificial Sequence
  Description of Artificial Sequence: Synthetic peptide
GGSLSGY

SEQ ID NO: 3272 - protein, 5 aa, Artificial Sequence
  Description of Artificial Sequence: Synthetic peptide
NQSGS

SEQ ID NO: 3273 - protein, 6 aa, Artificial Sequence
  Description of Artificial Sequence: Synthetic peptide
VLNWFD

SEQ ID NO: 3274 - protein, 7 aa, Artificial Sequence
  Description of Artificial Sequence: Synthetic peptide
SQDISNW

SEQ ID NO: 3275 - protein, 3 aa, Artificial Sequence
  Description of Artificial Sequence: Synthetic peptide
AAS

SEQ ID NO: 3276 - protein, 6 aa, Artificial Sequence
  Description of Artificial Sequence: Synthetic peptide
ANSFPY

SEQ ID NO: 3277 - protein, 10 aa, Artificial Sequence
  Description of Artificial Sequence: Synthetic peptide
GGSLSGYYWS

SEQ ID NO: 3278 - protein, 9 aa, Artificial Sequence
  Description of Artificial Sequence: Synthetic peptide
EINQSGSTN

SEQ ID NO: 3279 - protein, 7 aa, Artificial Sequence
  Description of Artificial Sequence: Synthetic peptide
VLNWFDP

SEQ ID NO: 3280 - protein, 11 aa, Artificial Sequence
  Description of Artificial Sequence: Synthetic peptide
RASQDISNWLA

SEQ ID NO: 3281 - protein, 7 aa, Artificial Sequence
  Description of Artificial Sequence: Synthetic peptide
AASSLQS

SEQ ID NO: 3282 - protein, 9 aa, Artificial Sequence
  Description of Artificial Sequence: Synthetic peptide
QQANSFPYT

SEQ ID NO: 3283 - protein, 6 aa, Artificial Sequence
  Description of Artificial Sequence: Synthetic peptide
SGYYWS

SEQ ID NO: 3284 - protein, 12 aa, Artificial Sequence
  Description of Artificial Sequence: Synthetic peptide
WIGEINQSGSTN

SEQ ID NO: 3285 - protein, 8 aa, Artificial Sequence
  Description of Artificial Sequence: Synthetic peptide
TRVLNWFD

SEQ ID NO: 3286 - protein, 7 aa, Artificial Sequence
  Description of Artificial Sequence: Synthetic peptide
SNWLAWY

SEQ ID NO: 3287 - protein, 10 aa, Artificial Sequence
  Description of Artificial Sequence: Synthetic peptide
LLIYAASSLQ

SEQ ID NO: 3288 - protein, 8 aa, Artificial Sequence
  Description of Artificial Sequence: Synthetic peptide
QQANSFPY

SEQ ID NO: 3289 - protein, 8 aa, Artificial Sequence
  Description of Artificial Sequence: Synthetic peptide
GGSLSGYY

SEQ ID NO: 3290 - protein, 7 aa, Artificial Sequence
  Description of Artificial Sequence: Synthetic peptide
INQSGST

SEQ ID NO: 3291 - protein, 9 aa, Artificial Sequence
  Description of Artificial Sequence: Synthetic peptide
TRVLNWFDP

SEQ ID NO: 3292 - protein, 6 aa, Artificial Sequence
  Description of Artificial Sequence: Synthetic peptide
QDISNW

SEQ ID NO: 3293 - protein, 3 aa, Artificial Sequence
  Description of Artificial Sequence: Synthetic peptide
AAS

SEQ ID NO: 3294 - protein, 9 aa, Artificial Sequence
  Description of Artificial Sequence: Synthetic peptide
QQANSFPYT

SEQ ID NO: 3295 - protein, 115 aa, Artificial Sequence
  Description of Artificial Sequence: Synthetic polypeptide
QVQLQQWGAGLLKPSETLSLTCAVYGGSLSGYYWSWIRQSPGKGLEWIGEINQSGSTNYNPSLKSRVTISVDTSKDQFSLRLTSVTAADTAVYYCTRVLNWFDPWGRGTLVTVSS

SEQ ID NO: 3296 - protein, 107 aa, Artificial Sequence
  Description of Artificial Sequence: Synthetic polypeptide
DIQMTQSPSSVSASVGDRVTLTCRASQDISNWLAWYQQKPGKAPKLLIYAASSLQSGVPSRFSGSGSGTDFTLTISSLQTEDFATYYCQQANSFPYTFGQGTKLEIK

SEQ ID NO: 3297 - protein, 445 aa, Artificial Sequence
  Description of Artificial Sequence: Synthetic peptide
QVQLQQWGAGLLKPSETLSLTCAVYGGSLSGYYWSWIRQSPGKGLEWIGEINQSGSTNYNPSLKSRVTISVDTSKDQFSLRLTSVTAADTAVYYCTRVLNWFDPWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3298 - protein, 214 aa, Artificial Sequence
  Description of Artificial Sequence: Synthetic peptide
DIQMTQSPSSVSASVGDRVTLTCRASQDISNWLAWYQQKPGKAPKLLIYAASSLQSGVPSRFSGSGSGTDFTLTISSLQTEDFATYYCQQANSFPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3299 - protein, 5 aa, Artificial Sequence
  Description of Artificial Sequence: Synthetic peptide
NTWMS

SEQ ID NO: 3300 - protein, 19 aa, Artificial Sequence
  Description of Artificial Sequence: Synthetic peptide
RIKSKIDGGTTDYAAPVKG

SEQ ID NO: 3301 - protein, 13 aa, Artificial Sequence
  Description of Artificial Sequence: Synthetic peptide
SGTYSSGWGLFDY

SEQ ID NO: 3302 - protein, 11 aa, Artificial Sequence
  Description of Artificial Sequence: Synthetic peptide
QASQDISNYLN

SEQ ID NO: 3303 - protein, 7 aa, Artificial Sequence
  Description of Artificial Sequence: Synthetic peptide
DTSNLEA

SEQ ID NO: 3304 - protein, 9 aa, Artificial Sequence
  Description of Artificial Sequence: Synthetic peptide
QQYDNLPFT

SEQ ID NO: 3305 - protein, 7 aa, Artificial Sequence
  Description of Artificial Sequence: Synthetic peptide
GFTFSNT

SEQ ID NO: 3306 - protein, 8 aa, Artificial Sequence
  Description of Artificial Sequence: Synthetic peptide
KSKIDGGT

SEQ ID NO: 3307 - protein, 12 aa, Artificial Sequence
  Description of Artificial Sequence: Synthetic peptide
SGTYSSGWGLFD

SEQ ID NO: 3308 - protein, 7 aa, Artificial Sequence
  Description of Artificial Sequence: Synthetic peptide
SQDISNY

SEQ ID NO: 3309 - protein, 3 aa, Artificial Sequence
  Description of Artificial Sequence: Synthetic peptide
DTS

SEQ ID NO: 3310 - protein, 6 aa, Artificial Sequence
  Description of Artificial Sequence: Synthetic peptide
YDNLPF

SEQ ID NO: 3311 - protein, 10 aa, Artificial Sequence
  Description of Artificial Sequence: Synthetic peptide
GFTFSNTWMS

SEQ ID NO: 3312 - protein, 12 aa, Artificial Sequence
  Description of Artificial Sequence: Synthetic peptide
RIKSKIDGGTTD

SEQ ID NO: 3313 - protein, 13 aa, Artificial Sequence
  Description of Artificial Sequence: Synthetic peptide
SGTYSSGWGLFDY

SEQ ID NO: 3314 - protein, 11 aa, Artificial Sequence
  Description of Artificial Sequence: Synthetic peptide
QASQDISNYLN

SEQ ID NO: 3315 - protein, 7 aa, Artificial Sequence
  Description of Artificial Sequence: Synthetic peptide
DTSNLEA

SEQ ID NO: 3316 - protein, 9 aa, Artificial Sequence
  Description of Artificial Sequence: Synthetic peptide
QQYDNLPFT

SEQ ID NO: 3317 - protein, 6 aa, Artificial Sequence
  Description of Artificial Sequence: Synthetic peptide
SNTWMS

SEQ ID NO: 3318 - protein, 15 aa, Artificial Sequence
  Description of Artificial Sequence: Synthetic peptide
WVGRIKSKIDGGTTD

SEQ ID NO: 3319 - protein, 14 aa, Artificial Sequence
  Description of Artificial Sequence: Synthetic peptide
TTSGTYSSGWGLFD

SEQ ID NO: 3320 - protein, 7 aa, Artificial Sequence
  Description of Artificial Sequence: Synthetic peptide
SNYLNWY

SEQ ID NO: 3321 - protein, 10 aa, Artificial Sequence
  Description of Artificial Sequence: Synthetic peptide
LLIYDTSNLE

SEQ ID NO: 3322 - protein, 8 aa, Artificial Sequence
  Description of Artificial Sequence: Synthetic peptide
QQYDNLPF

SEQ ID NO: 3323 - protein, 8 aa, Artificial Sequence
  Description of Artificial Sequence: Synthetic peptide
GFTFSNTW

SEQ ID NO: 3324 - protein, 10 aa, Artificial Sequence
  Description of Artificial Sequence: Synthetic peptide
IKSKIDGGTT

SEQ ID NO: 3325 - protein, 15 aa, Artificial Sequence
  Description of Artificial Sequence: Synthetic peptide
TTSGTYSSGWGLFDY

SEQ ID NO: 3326 - protein, 6 aa, Artificial Sequence
  Description of Artificial Sequence: Synthetic peptide
QDISNY

SEQ ID NO: 3327 - protein, 3 aa, Artificial Sequence
  Description of Artificial Sequence: Synthetic peptide
DTS

SEQ ID NO: 3328 - protein, 9 aa, Artificial Sequence
  Description of Artificial Sequence: Synthetic peptide
QQYDNLPFT

SEQ ID NO: 3329 - protein, 124 aa, Artificial Sequence
  Description of Artificial Sequence: Synthetic polypeptide
EVQLVESGGGLVKPGGSLTLSCAASGFTFSNTWMSWVRQAPGKGLEWVGRIKSKIDGGTTDYAAPVKGRFTISRDDSKNTLYLQMNSLKTEDTAVYYCTTSGTYSSGWGLFDYWGQGTLVTVSS

SEQ ID NO: 3330 - protein, 107 aa, Artificial Sequence
  Description of Artificial Sequence: Synthetic polypeptide
DIQMTQSPSSLSASVGDRVTITCQASQDISNYLNWYQQKPGKAPKLLIYDTSNLEAGVPSRFSGSGSGTHFTLTISSLQPEDIATYYCQQYDNLPFTFGGGTRVEIK

SEQ ID NO: 3331-3332 - skipped (2 entries)

SEQ ID NO: 3333 - protein, 5 aa, Artificial Sequence
  Description of Artificial Sequence: Synthetic peptide
GYYWT

SEQ ID NO: 3334 - protein, 16 aa, Artificial Sequence
  Description of Artificial Sequence: Synthetic peptide
EINHRGSTNYNPSLKS

SEQ ID NO: 3335 - protein, 8 aa, Artificial Sequence
  Description of Artificial Sequence: Synthetic peptide
PDSNWFDP

SEQ ID NO: 3336 - protein, 11 aa, Artificial Sequence
  Description of Artificial Sequence: Synthetic peptide
RASQDISNWLA

SEQ ID NO: 3337 - protein, 7 aa, Artificial Sequence
  Description of Artificial Sequence: Synthetic peptide
AASSLQS

SEQ ID NO: 3338 - protein, 9 aa, Artificial Sequence
  Description of Artificial Sequence: Synthetic peptide
QQANSFPLT

SEQ ID NO: 3339 - protein, 7 aa, Artificial Sequence
  Description of Artificial Sequence: Synthetic peptide
GGSFSGY

SEQ ID NO: 3340 - protein, 5 aa, Artificial Sequence
  Description of Artificial Sequence: Synthetic peptide
NHRGS

SEQ ID NO: 3341 - protein, 7 aa, Artificial Sequence
  Description of Artificial Sequence: Synthetic peptide
PDSNWFD

SEQ ID NO: 3342 - protein, 7 aa, Artificial Sequence
  Description of Artificial Sequence: Synthetic peptide
SQDISNW

SEQ ID NO: 3343 - protein, 3 aa, Artificial Sequence
  Description of Artificial Sequence: Synthetic peptide
AAS

SEQ ID NO: 3344 - protein, 6 aa, Artificial Sequence
  Description of Artificial Sequence: Synthetic peptide
ANSFPL

SEQ ID NO: 3345 - protein, 10 aa, Artificial Sequence
  Description of Artificial Sequence: Synthetic peptide
GGSFSGYYWT

SEQ ID NO: 3346 - protein, 9 aa, Artificial Sequence
  Description of Artificial Sequence: Synthetic peptide
EINHRGSTN

SEQ ID NO: 3347 - protein, 8 aa, Artificial Sequence
  Description of Artificial Sequence: Synthetic peptide
PDSNWFDP

SEQ ID NO: 3348 - protein, 11 aa, Artificial Sequence
  Description of Artificial Sequence: Synthetic peptide
RASQDISNWLA

SEQ ID NO: 3349 - protein, 7 aa, Artificial Sequence
  Description of Artificial Sequence: Synthetic peptide
AASSLQS

SEQ ID NO: 3350 - protein, 9 aa, Artificial Sequence
  Description of Artificial Sequence: Synthetic peptide
QQANSFPLT

SEQ ID NO: 3351 - protein, 6 aa, Artificial Sequence
  Description of Artificial Sequence: Synthetic peptide
SGYYWT

SEQ ID NO: 3352 - protein, 12 aa, Artificial Sequence
  Description of Artificial Sequence: Synthetic peptide
WIGEINHRGSTN

SEQ ID NO: 3353 - protein, 9 aa, Artificial Sequence
  Description of Artificial Sequence: Synthetic peptide
TRPDSNWFD

SEQ ID NO: 3354 - protein, 7 aa, Artificial Sequence
  Description of Artificial Sequence: Synthetic peptide
SNWLAWY

SEQ ID NO: 3355 - protein, 10 aa, Artificial Sequence
  Description of Artificial Sequence: Synthetic peptide
LLIFAASSLQ

SEQ ID NO: 3356 - protein, 8 aa, Artificial Sequence
  Description of Artificial Sequence: Synthetic peptide
QQANSFPL

SEQ ID NO: 3357 - protein, 8 aa, Artificial Sequence
  Description of Artificial Sequence: Synthetic peptide
GGSFSGYY

SEQ ID NO: 3358 - protein, 7 aa, Artificial Sequence
  Description of Artificial Sequence: Synthetic peptide
INHRGST

SEQ ID NO: 3359 - protein, 10 aa, Artificial Sequence
  Description of Artificial Sequence: Synthetic peptide
TRPDSNWFDP

SEQ ID NO: 3360 - protein, 6 aa, Artificial Sequence
  Description of Artificial Sequence: Synthetic peptide
QDISNW

SEQ ID NO: 3361 - protein, 3 aa, Artificial Sequence
  Description of Artificial Sequence: Synthetic peptide
AAS

SEQ ID NO: 3362 - protein, 9 aa, Artificial Sequence
  Description of Artificial Sequence: Synthetic peptide
QQANSFPLT

SEQ ID NO: 3363 - protein, 116 aa, Artificial Sequence
  Description of Artificial Sequence: Synthetic polypeptide
QVLLEQWGAGLLKPSETLSLTCAVYGGSFSGYYWTWIRQPPGKGLEWIGEINHRGSTNYNPSLKSRVTISIDTSKNQFSLKVKSVTAADTAMYYCTRPDSNWFDPWGQGTLVTVSS

SEQ ID NO: 3364 - protein, 107 aa, Artificial Sequence
  Description of Artificial Sequence: Synthetic polypeptide
DIQMTQSPSSVSASVGDRVTITCRASQDISNWLAWYQQKPGKAPKLLIFAASSLQSGVPSRFSGSGSGTDFTLTISSLQPEDFATYYCQQANSFPLTFGGGTKVEIK

SEQ ID NO: 3365-3366 - skipped (2 entries)

SEQ ID NO: 3367 - protein, 5 aa, Artificial Sequence
  Description of Artificial Sequence: Synthetic peptide
SYYWS

SEQ ID NO: 3368 - protein, 16 aa, Artificial Sequence
  Description of Artificial Sequence: Synthetic peptide
RIYTSGSTNYNPSLKS

SEQ ID NO: 3369 - protein, 10 aa, Artificial Sequence
  Description of Artificial Sequence: Synthetic peptide
DGGVGDSLDY

SEQ ID NO: 3370 - protein, 17 aa, Artificial Sequence
  Description of Artificial Sequence: Synthetic peptide
RSSQSLLDSDDGNTYLD

SEQ ID NO: 3371 - protein, 7 aa, Artificial Sequence
  Description of Artificial Sequence: Synthetic peptide
TLSYRAS

SEQ ID NO: 3372 - protein, 9 aa, Artificial Sequence
  Description of Artificial Sequence: Synthetic peptide
MQHIEFPFT

SEQ ID NO: 3373 - protein, 7 aa, Artificial Sequence
  Description of Artificial Sequence: Synthetic peptide
GGSIGSY

SEQ ID NO: 3374 - protein, 5 aa, Artificial Sequence
  Description of Artificial Sequence: Synthetic peptide
YTSGS

SEQ ID NO: 3375 - protein, 9 aa, Artificial Sequence
  Description of Artificial Sequence: Synthetic peptide
DGGVGDSLD

SEQ ID NO: 3376 - protein, 13 aa, Artificial Sequence
  Description of Artificial Sequence: Synthetic peptide
SQSLLDSDDGNTY

SEQ ID NO: 3377 - protein, 3 aa, Artificial Sequence
  Description of Artificial Sequence: Synthetic peptide
TLS

SEQ ID NO: 3378 - protein, 6 aa, Artificial Sequence
  Description of Artificial Sequence: Synthetic peptide
HIEFPF

SEQ ID NO: 3379 - protein, 10 aa, Artificial Sequence
  Description of Artificial Sequence: Synthetic peptide
GGSIGSYYWS

SEQ ID NO: 3380 - protein, 9 aa, Artificial Sequence
  Description of Artificial Sequence: Synthetic peptide
RIYTSGSTN

SEQ ID NO: 3381 - protein, 10 aa, Artificial Sequence
  Description of Artificial Sequence: Synthetic peptide
DGGVGDSLDY

SEQ ID NO: 3382 - protein, 17 aa, Artificial Sequence
  Description of Artificial Sequence: Synthetic peptide
RSSQSLLDSDDGNTYLD

SEQ ID NO: 3383 - protein, 7 aa, Artificial Sequence
  Description of Artificial Sequence: Synthetic peptide
TLSYRAS

SEQ ID NO: 3384 - protein, 9 aa, Artificial Sequence
  Description of Artificial Sequence: Synthetic peptide
MQHIEFPFT

SEQ ID NO: 3385 - protein, 6 aa, Artificial Sequence
  Description of Artificial Sequence: Synthetic peptide
GSYYWS

SEQ ID NO: 3386 - protein, 12 aa, Artificial Sequence
  Description of Artificial Sequence: Synthetic peptide
WIGRIYTSGSTN

SEQ ID NO: 3387 - protein, 11 aa, Artificial Sequence
  Description of Artificial Sequence: Synthetic peptide
ATDGGVGDSLD

SEQ ID NO: 3388 - protein, 13 aa, Artificial Sequence
  Description of Artificial Sequence: Synthetic peptide
LDSDDGNTYLDWY

SEQ ID NO: 3389 - protein, 10 aa, Artificial Sequence
  Description of Artificial Sequence: Synthetic peptide
LLIYTLSYRA

SEQ ID NO: 3390 - protein, 8 aa, Artificial Sequence
  Description of Artificial Sequence: Synthetic peptide
MQHIEFPF

SEQ ID NO: 3391 - protein, 8 aa, Artificial Sequence
  Description of Artificial Sequence: Synthetic peptide
GGSIGSYY

SEQ ID NO: 3392 - protein, 7 aa, Artificial Sequence
  Description of Artificial Sequence: Synthetic peptide
IYTSGST

SEQ ID NO: 3393 - protein, 12 aa, Artificial Sequence
  Description of Artificial Sequence: Synthetic peptide
ATDGGVGDSLDY

SEQ ID NO: 3394 - protein, 12 aa, Artificial Sequence
  Description of Artificial Sequence: Synthetic peptide
QSLLDSDDGNTY

SEQ ID NO: 3395 - protein, 3 aa, Artificial Sequence
  Description of Artificial Sequence: Synthetic peptide
TLS

SEQ ID NO: 3396 - protein, 9 aa, Artificial Sequence
  Description of Artificial Sequence: Synthetic peptide
MQHIEFPFT

SEQ ID NO: 3397 - protein, 118 aa, Artificial Sequence
  Description of Artificial Sequence: Synthetic polypeptide
QVQLQESGPGLVKPSETLSLTCTVSGGSIGSYYWSWIRQPAGKGLEWIGRIYTSGSTNYNPSLKSRVTMSFDTSKNQFSLKLNSVTAADTAVYYCATDGGVGDSLDYWGQGTLVTVSS

SEQ ID NO: 3398 - protein, 113 aa, Artificial Sequence
  Description of Artificial Sequence: Synthetic polypeptide
DIVMTQTPLSLPVTPGEPASISCRSSQSLLDSDDGNTYLDWYLQKPGQSPQLLIYTLSYRASGVPDRFSGSGSGTDFTLKISRVEAEDVGVYYCMQHIEFPFTFGPGTKVDIK

SEQ ID NO: 3399 - protein, 448 aa, Artificial Sequence
  Description of Artificial Sequence: Synthetic peptide
QVQLQESGPGLVKPSETLSLTCTVSGGSIGSYYWSWIRQPAGKGLEWIGRIYTSGSTNYNPSLKSRVTMSFDTSKNQFSLKLNSVTAADTAVYYCATDGGVGDSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3400 - protein, 220 aa, Artificial Sequence
  Description of Artificial Sequence: Synthetic peptide
DIVMTQTPLSLPVTPGEPASISCRSSQSLLDSDDGNTYLDWYLQKPGQSPQLLIYTLSYRASGVPDRFSGSGSGTDFTLKISRVEAEDVGVYYCMQHIEFPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3401 - protein, 5 aa, Artificial Sequence
  Description of Artificial Sequence: Synthetic peptide
NAWMS

SEQ ID NO: 3402 - protein, 19 aa, Artificial Sequence
  Description of Artificial Sequence: Synthetic peptide
RVESKTDGGTTDYAAPVKD

SEQ ID NO: 3403 - protein, 14 aa, Artificial Sequence
  Description of Artificial Sequence: Synthetic peptide
GGGFGLELYGFFDY

SEQ ID NO: 3404 - protein, 11 aa, Artificial Sequence
  Description of Artificial Sequence: Synthetic peptide
RASQSISSWLA

SEQ ID NO: 3405 - protein, 7 aa, Artificial Sequence
  Description of Artificial Sequence: Synthetic peptide
KASSLES

SEQ ID NO: 3406 - protein, 8 aa, Artificial Sequence
  Description of Artificial Sequence: Synthetic peptide
LQYNSYYT

SEQ ID NO: 3407 - protein, 7 aa, Artificial Sequence
  Description of Artificial Sequence: Synthetic peptide
GFSFSNA

SEQ ID NO: 3408 - protein, 8 aa, Artificial Sequence
  Description of Artificial Sequence: Synthetic peptide
ESKTDGGT

SEQ ID NO: 3409 - protein, 13 aa, Artificial Sequence
  Description of Artificial Sequence: Synthetic peptide
GGGFGLELYGFFD

SEQ ID NO: 3410 - protein, 7 aa, Artificial Sequence
  Description of Artificial Sequence: Synthetic peptide
SQSISSW

SEQ ID NO: 3411 - protein, 3 aa, Artificial Sequence
  Description of Artificial Sequence: Synthetic peptide
KAS

SEQ ID NO: 3412 - protein, 5 aa, Artificial Sequence
  Description of Artificial Sequence: Synthetic peptide
YNSYY

SEQ ID NO: 3413 - protein, 10 aa, Artificial Sequence
  Description of Artificial Sequence: Synthetic peptide
GFSFSNAWMS

SEQ ID NO: 3414 - protein, 12 aa, Artificial Sequence
  Description of Artificial Sequence: Synthetic peptide
RVESKTDGGTTD

SEQ ID NO: 3415 - protein, 14 aa, Artificial Sequence
  Description of Artificial Sequence: Synthetic peptide
GGGFGLELYGFFDY

SEQ ID NO: 3416 - protein, 11 aa, Artificial Sequence
  Description of Artificial Sequence: Synthetic peptide
RASQSISSWLA

SEQ ID NO: 3417 - protein, 7 aa, Artificial Sequence
  Description of Artificial Sequence: Synthetic peptide
KASSLES

SEQ ID NO: 3418 - protein, 8 aa, Artificial Sequence
  Description of Artificial Sequence: Synthetic peptide
LQYNSYYT

SEQ ID NO: 3419 - protein, 6 aa, Artificial Sequence
  Description of Artificial Sequence: Synthetic peptide
SNAWMS

SEQ ID NO: 3420 - protein, 15 aa, Artificial Sequence
  Description of Artificial Sequence: Synthetic peptide
WVGRVESKTDGGTTD

SEQ ID NO: 3421 - protein, 15 aa, Artificial Sequence
  Description of Artificial Sequence: Synthetic peptide
TIGGGFGLELYGFFD

SEQ ID NO: 3422 - protein, 7 aa, Artificial Sequence
  Description of Artificial Sequence: Synthetic peptide
SSWLAWY

SEQ ID NO: 3423 - protein, 10 aa, Artificial Sequence
  Description of Artificial Sequence: Synthetic peptide
LLIYKASSLE

SEQ ID NO: 3424 - protein, 7 aa, Artificial Sequence
  Description of Artificial Sequence: Synthetic peptide
LQYNSYY

SEQ ID NO: 3425 - protein, 8 aa, Artificial Sequence
  Description of Artificial Sequence: Synthetic peptide
GFSFSNAW

SEQ ID NO: 3426 - protein, 10 aa, Artificial Sequence
  Description of Artificial Sequence: Synthetic peptide
VESKTDGGTT

SEQ ID NO: 3427 - protein, 16 aa, Artificial Sequence
  Description of Artificial Sequence: Synthetic peptide
TIGGGFGLELYGFFDY

SEQ ID NO: 3428 - protein, 6 aa, Artificial Sequence
  Description of Artificial Sequence: Synthetic peptide
QSISSW

SEQ ID NO: 3429 - protein, 3 aa, Artificial Sequence
  Description of Artificial Sequence: Synthetic peptide
KAS

SEQ ID NO: 3430 - protein, 8 aa, Artificial Sequence
  Description of Artificial Sequence: Synthetic peptide
LQYNSYYT

SEQ ID NO: 3431 - protein, 125 aa, Artificial Sequence
  Description of Artificial Sequence: Synthetic polypeptide
EVQLVESGGDLVKPGGSLRLSCAASGFSFSNAWMSWVRQAPGKGLEWVGRVESKTDGGTTDYAAPVKDRFTISRDDSKYTLYLQMNSLKTEDSAVYYCTIGGGFGLELYGFFDYWGQGTLVTVSS

SEQ ID NO: 3432 - protein, 106 aa, Artificial Sequence
  Description of Artificial Sequence: Synthetic polypeptide
DIQMTQSPSTLSASVGDRVTITCRASQSISSWLAWYQQKPGKAPMLLIYKASSLESGVPSRFSGSGSGTEFTLTISSLQPDDFATYYCLQYNSYYTFGQGTKLEIK

SEQ ID NO: 3433-3434 - skipped (2 entries)

SEQ ID NO: 3435 - protein, 5 aa, Artificial Sequence
  Description of Artificial Sequence: Synthetic peptide
NYDVH

SEQ ID NO: 3436 - protein, 16 aa, Artificial Sequence
  Description of Artificial Sequence: Synthetic peptide
TIGTAGDTYYPGSVKG

SEQ ID NO: 3437 - protein, 10 aa, Artificial Sequence
  Description of Artificial Sequence: Synthetic peptide
GGYDYYGLDV

SEQ ID NO: 3438 - protein, 12 aa, Artificial Sequence
  Description of Artificial Sequence: Synthetic peptide
RASQSVSSTYLA

SEQ ID NO: 3439 - protein, 7 aa, Artificial Sequence
  Description of Artificial Sequence: Synthetic peptide
GASSRAT

SEQ ID NO: 3440 - protein, 9 aa, Artificial Sequence
  Description of Artificial Sequence: Synthetic peptide
QQYGSSPFT

SEQ ID NO: 3441 - protein, 7 aa, Artificial Sequence
  Description of Artificial Sequence: Synthetic peptide
GFTFSNY

SEQ ID NO: 3442 - protein, 5 aa, Artificial Sequence
  Description of Artificial Sequence: Synthetic peptide
GTAGD

SEQ ID NO: 3443 - protein, 9 aa, Artificial Sequence
  Description of Artificial Sequence: Synthetic peptide
GGYDYYGLD

SEQ ID NO: 3444 - protein, 8 aa, Artificial Sequence
  Description of Artificial Sequence: Synthetic peptide
SQSVSSTY

SEQ ID NO: 3445 - protein, 3 aa, Artificial Sequence
  Description of Artificial Sequence: Synthetic peptide
GAS

SEQ ID NO: 3446 - protein, 6 aa, Artificial Sequence
  Description of Artificial Sequence: Synthetic peptide
YGSSPF

SEQ ID NO: 3447 - protein, 10 aa, Artificial Sequence
  Description of Artificial Sequence: Synthetic peptide
GFTFSNYDVH

SEQ ID NO: 3448 - protein, 9 aa, Artificial Sequence
  Description of Artificial Sequence: Synthetic peptide
TIGTAGDTY

SEQ ID NO: 3449 - protein, 10 aa, Artificial Sequence
  Description of Artificial Sequence: Synthetic peptide
GGYDYYGLDV

SEQ ID NO: 3450 - protein, 12 aa, Artificial Sequence
  Description of Artificial Sequence: Synthetic peptide
RASQSVSSTYLA

SEQ ID NO: 3451 - protein, 7 aa, Artificial Sequence
  Description of Artificial Sequence: Synthetic peptide
GASSRAT

SEQ ID NO: 3452 - protein, 9 aa, Artificial Sequence
  Description of Artificial Sequence: Synthetic peptide
QQYGSSPFT

SEQ ID NO: 3453 - protein, 6 aa, Artificial Sequence
  Description of Artificial Sequence: Synthetic peptide
SNYDVH

SEQ ID NO: 3454 - protein, 12 aa, Artificial Sequence
  Description of Artificial Sequence: Synthetic peptide
WVSTIGTAGDTY

SEQ ID NO: 3455 - protein, 11 aa, Artificial Sequence
  Description of Artificial Sequence: Synthetic peptide
ARGGYDYYGLD

SEQ ID NO: 3456 - protein, 8 aa, Artificial Sequence
  Description of Artificial Sequence: Synthetic peptide
SSTYLAWY

SEQ ID NO: 3457 - protein, 10 aa, Artificial Sequence
  Description of Artificial Sequence: Synthetic peptide
LLIFGASSRA

SEQ ID NO: 3458 - protein, 8 aa, Artificial Sequence
  Description of Artificial Sequence: Synthetic peptide
QQYGSSPF

SEQ ID NO: 3459 - protein, 8 aa, Artificial Sequence
  Description of Artificial Sequence: Synthetic peptide
GFTFSNYD

SEQ ID NO: 3460 - protein, 7 aa, Artificial Sequence
  Description of Artificial Sequence: Synthetic peptide
IGTAGDT

SEQ ID NO: 3461 - protein, 12 aa, Artificial Sequence
  Description of Artificial Sequence: Synthetic peptide
ARGGYDYYGLDV

SEQ ID NO: 3462 - protein, 7 aa, Artificial Sequence
  Description of Artificial Sequence: Synthetic peptide
QSVSSTY

SEQ ID NO: 3463 - protein, 3 aa, Artificial Sequence
  Description of Artificial Sequence: Synthetic peptide
GAS

SEQ ID NO: 3464 - protein, 9 aa, Artificial Sequence
  Description of Artificial Sequence: Synthetic peptide
QQYGSSPFT

SEQ ID NO: 3465 - protein, 118 aa, Artificial Sequence
  Description of Artificial Sequence: Synthetic polypeptide
EVQLVESGGGLVQPGGSLRLSCAASGFTFSNYDVHWVRQPTGKGLEWVSTIGTAGDTYYPGSVKGRFTISRENAKNSLYLQMNSLRAGDTAVYYCARGGYDYYGLDVWGQGTTVTVSS

SEQ ID NO: 3466 - protein, 108 aa, Artificial Sequence
  Description of Artificial Sequence: Synthetic polypeptide
EIVLTQSPGTLSLSPGERATLSCRASQSVSSTYLAWYQQKPGQAPRLLIFGASSRATGIPDRFSGSGSGTDFTLTISRLEPEDFAVYYCQQYGSSPFTFGPGTKVDIK

SEQ ID NO: 3467-3468 - skipped (2 entries)

SEQ ID NO: 3469 - protein, 7 aa, Artificial Sequence
  Description of Artificial Sequence: Synthetic peptide
SGGYFWS

SEQ ID NO: 3470 - protein, 16 aa, Artificial Sequence
  Description of Artificial Sequence: Synthetic peptide
CIYYSGSTYYIPSLKS

SEQ ID NO: 3471 - protein, 10 aa, Artificial Sequence
  Description of Artificial Sequence: Synthetic peptide
DGYDYWYFDL

SEQ ID NO: 3472 - protein, 12 aa, Artificial Sequence
  Description of Artificial Sequence: Synthetic peptide
RASQSVSSSYLA

SEQ ID NO: 3473 - protein, 7 aa, Artificial Sequence
  Description of Artificial Sequence: Synthetic peptide
GASSRAT

SEQ ID NO: 3474 - protein, 9 aa, Artificial Sequence
  Description of Artificial Sequence: Synthetic peptide
QQYGSSPYT

SEQ ID NO: 3475 - protein, 9 aa, Artificial Sequence
  Description of Artificial Sequence: Synthetic peptide
GGSISSGGY

SEQ ID NO: 3476 - protein, 5 aa, Artificial Sequence
  Description of Artificial Sequence: Synthetic peptide
YYSGS

SEQ ID NO: 3477 - protein, 9 aa, Artificial Sequence
  Description of Artificial Sequence: Synthetic peptide
DGYDYWYFD

SEQ ID NO: 3478 - protein, 8 aa, Artificial Sequence
  Description of Artificial Sequence: Synthetic peptide
SQSVSSSY

SEQ ID NO: 3479 - protein, 3 aa, Artificial Sequence
  Description of Artificial Sequence: Synthetic peptide
GAS

SEQ ID NO: 3480 - protein, 6 aa, Artificial Sequence
  Description of Artificial Sequence: Synthetic peptide
YGSSPY

SEQ ID NO: 3481 - protein, 12 aa, Artificial Sequence
  Description of Artificial Sequence: Synthetic peptide
GGSISSGGYFWS

SEQ ID NO: 3482 - protein, 9 aa, Artificial Sequence
  Description of Artificial Sequence: Synthetic peptide
CIYYSGSTY

SEQ ID NO: 3483 - protein, 10 aa, Artificial Sequence
  Description of Artificial Sequence: Synthetic peptide
DGYDYWYFDL

SEQ ID NO: 3484 - protein, 12 aa, Artificial Sequence
  Description of Artificial Sequence: Synthetic peptide
RASQSVSSSYLA

SEQ ID NO: 3485 - protein, 7 aa, Artificial Sequence
  Description of Artificial Sequence: Synthetic peptide
GASSRAT

SEQ ID NO: 3486 - protein, 9 aa, Artificial Sequence
  Description of Artificial Sequence: Synthetic peptide
QQYGSSPYT

SEQ ID NO: 3487 - protein, 8 aa, Artificial Sequence
  Description of Artificial Sequence: Synthetic peptide
SSGGYFWS

SEQ ID NO: 3488 - protein, 12 aa, Artificial Sequence
  Description of Artificial Sequence: Synthetic peptide
WIGCIYYSGSTY

SEQ ID NO: 3489 - protein, 11 aa, Artificial Sequence
  Description of Artificial Sequence: Synthetic peptide
ARDGYDYWYFD

SEQ ID NO: 3490 - protein, 8 aa, Artificial Sequence
  Description of Artificial Sequence: Synthetic peptide
SSSYLAWY

SEQ ID NO: 3491 - protein, 10 aa, Artificial Sequence
  Description of Artificial Sequence: Synthetic peptide
LLIYGASSRA

SEQ ID NO: 3492 - protein, 8 aa, Artificial Sequence
  Description of Artificial Sequence: Synthetic peptide
QQYGSSPY

SEQ ID NO: 3493 - protein, 10 aa, Artificial Sequence
  Description of Artificial Sequence: Synthetic peptide
GGSISSGGYF

SEQ ID NO: 3494 - protein, 7 aa, Artificial Sequence
  Description of Artificial Sequence: Synthetic peptide
IYYSGST

SEQ ID NO: 3495 - protein, 12 aa, Artificial Sequence
  Description of Artificial Sequence: Synthetic peptide
ARDGYDYWYFDL

SEQ ID NO: 3496 - protein, 7 aa, Artificial Sequence
  Description of Artificial Sequence: Synthetic peptide
QSVSSSY

SEQ ID NO: 3497 - protein, 3 aa, Artificial Sequence
  Description of Artificial Sequence: Synthetic peptide
GAS

SEQ ID NO: 3498 - protein, 9 aa, Artificial Sequence
  Description of Artificial Sequence: Synthetic peptide
QQYGSSPYT

SEQ ID NO: 3499 - protein, 120 aa, Artificial Sequence
  Description of Artificial Sequence: Synthetic polypeptide
QVQLQESGPGLVKPSQTLSLTCTVSGGSISSGGYFWSWIRQHPGKGLEWIGCIYYSGSTYYIPSLKSRVTISVDTSKNQFSLKLRSVTAADTAVYYCARDGYDYWYFDLWGRGTLVTVSS

SEQ ID NO: 3500 - protein, 108 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPYTFGQGTKLEIK

SEQ ID NO: 3501-3502 - skipped (2 entries)

SEQ ID NO: 3503 - protein, 5 aa, Artificial Sequence
  Description of Artificial Sequence: Synthetic peptide
SYDMH

SEQ ID NO: 3504 - protein, 16 aa, Artificial Sequence
  Description of Artificial Sequence: Synthetic peptide
TIGTAGDTYYPASVKG

SEQ ID NO: 3505 - protein, 10 aa, Artificial Sequence
  Description of Artificial Sequence: Synthetic peptide
GGFYYYGMDV

SEQ ID NO: 3506 - protein, 12 aa, Artificial Sequence
  Description of Artificial Sequence: Synthetic peptide
RASQSVSNTYLA

SEQ ID NO: 3507 - protein, 7 aa, Artificial Sequence
  Description of Artificial Sequence: Synthetic peptide
GASSRAT

SEQ ID NO: 3508 - protein, 9 aa, Artificial Sequence
  Description of Artificial Sequence: Synthetic peptide
QQHGSSPFT

SEQ ID NO: 3509 - protein, 7 aa, Artificial Sequence
  Description of Artificial Sequence: Synthetic peptide
GFTFSSY

SEQ ID NO: 3510 - protein, 5 aa, Artificial Sequence
  Description of Artificial Sequence: Synthetic peptide
GTAGD

SEQ ID NO: 3511 - protein, 9 aa, Artificial Sequence
  Description of Artificial Sequence: Synthetic peptide
GGFYYYGMD

SEQ ID NO: 3512 - protein, 8 aa, Artificial Sequence
  Description of Artificial Sequence: Synthetic peptide
SQSVSNTY

SEQ ID NO: 3513 - protein, 3 aa, Artificial Sequence
  Description of Artificial Sequence: Synthetic peptide
GAS

SEQ ID NO: 3514 - protein, 6 aa, Artificial Sequence
  Description of Artificial Sequence: Synthetic peptide
HGSSPF

SEQ ID NO: 3515 - protein, 10 aa, Artificial Sequence
  Description of Artificial Sequence: Synthetic peptide
GFTFSSYDMH

SEQ ID NO: 3516 - protein, 9 aa, Artificial Sequence
  Description of Artificial Sequence: Synthetic peptide
TIGTAGDTY

SEQ ID NO: 3517 - protein, 10 aa, Artificial Sequence
  Description of Artificial Sequence: Synthetic peptide
GGFYYYGMDV

SEQ ID NO: 3518 - protein, 12 aa, Artificial Sequence
  Description of Artificial Sequence: Synthetic peptide
RASQSVSNTYLA

SEQ ID NO: 3519 - protein, 7 aa, Artificial Sequence
  Description of Artificial Sequence: Synthetic peptide
GASSRAT

SEQ ID NO: 3520 - protein, 9 aa, Artificial Sequence
  Description of Artificial Sequence: Synthetic peptide
QQHGSSPFT

SEQ ID NO: 3521 - protein, 6 aa, Artificial Sequence
  Description of Artificial Sequence: Synthetic peptide
SSYDMH

SEQ ID NO: 3522 - protein, 12 aa, Artificial Sequence
  Description of Artificial Sequence: Synthetic peptide
WVSTIGTAGDTY

SEQ ID NO: 3523 - protein, 11 aa, Artificial Sequence
  Description of Artificial Sequence: Synthetic peptide
ARGGFYYYGMD

SEQ ID NO: 3524 - protein, 8 aa, Artificial Sequence
  Description of Artificial Sequence: Synthetic peptide
SNTYLAWY

SEQ ID NO: 3525 - protein, 10 aa, Artificial Sequence
  Description of Artificial Sequence: Synthetic peptide
LLIYGASSRA

SEQ ID NO: 3526 - protein, 8 aa, Artificial Sequence
  Description of Artificial Sequence: Synthetic peptide
QQHGSSPF

SEQ ID NO: 3527 - protein, 8 aa, Artificial Sequence
  Description of Artificial Sequence: Synthetic peptide
GFTFSSYD

SEQ ID NO: 3528 - protein, 7 aa, Artificial Sequence
  Description of Artificial Sequence: Synthetic peptide
IGTAGDT

SEQ ID NO: 3529 - protein, 12 aa, Artificial Sequence
  Description of Artificial Sequence: Synthetic peptide
ARGGFYYYGMDV

SEQ ID NO: 3530 - protein, 7 aa, Artificial Sequence
  Description of Artificial Sequence: Synthetic peptide
QSVSNTY

SEQ ID NO: 3531 - protein, 3 aa, Artificial Sequence
  Description of Artificial Sequence: Synthetic peptide
GAS

SEQ ID NO: 3532 - protein, 9 aa, Artificial Sequence
  Description of Artificial Sequence: Synthetic peptide
QQHGSSPFT

SEQ ID NO: 3533 - protein, 118 aa, Artificial Sequence
  Description of Artificial Sequence: Synthetic polypeptide
EVQLVESGGGLVQPGGSLRLSCAASGFTFSSYDMHWVRQPTGKGLEWVSTIGTAGDTYYPASVKGRFTISRENAKNSLYLQMNSLRAGDTAVYYCARGGFYYYGMDVWGQGTTVTVSS

SEQ ID NO: 3534 - protein, 108 aa, Artificial Sequence
  Description of Artificial Sequence: Synthetic polypeptide
EIVLTQSPGTLSLSPGERVTLSCRASQSVSNTYLAWYQQKPGQAPRLLIYGASSRATGIPDRFSGSGSGTDFTLTISRLEPEDFVVYYCQQHGSSPFTFGPGTKVDIK

SEQ ID NO: 3535-3536 - skipped (2 entries)

SEQ ID NO: 3537 - protein, 5 aa, Artificial Sequence
  Description of Artificial Sequence: Synthetic peptide
SYWMS

SEQ ID NO: 3538 - protein, 17 aa, Artificial Sequence
  Description of Artificial Sequence: Synthetic peptide
NINQDGSDKYYVDSVKG

SEQ ID NO: 3539 - protein, 10 aa, Artificial Sequence
  Description of Artificial Sequence: Synthetic peptide
EGGQWLTLDY

SEQ ID NO: 3540 - protein, 12 aa, Artificial Sequence
  Description of Artificial Sequence: Synthetic peptide
RASQSVSSTYLA

SEQ ID NO: 3541 - protein, 7 aa, Artificial Sequence
  Description of Artificial Sequence: Synthetic peptide
GASSRAT

SEQ ID NO: 3542 - protein, 9 aa, Artificial Sequence
  Description of Artificial Sequence: Synthetic peptide
QQYGSSPFT

SEQ ID NO: 3543 - protein, 7 aa, Artificial Sequence
  Description of Artificial Sequence: Synthetic peptide
GFTFSSY

SEQ ID NO: 3544 - protein, 6 aa, Artificial Sequence
  Description of Artificial Sequence: Synthetic peptide
NQDGSD

SEQ ID NO: 3545 - protein, 9 aa, Artificial Sequence
  Description of Artificial Sequence: Synthetic peptide
EGGQWLTLD

SEQ ID NO: 3546 - protein, 8 aa, Artificial Sequence
  Description of Artificial Sequence: Synthetic peptide
SQSVSSTY

SEQ ID NO: 3547 - protein, 3 aa, Artificial Sequence
  Description of Artificial Sequence: Synthetic peptide
GAS

SEQ ID NO: 3548 - protein, 6 aa, Artificial Sequence
  Description of Artificial Sequence: Synthetic peptide
YGSSPF

SEQ ID NO: 3549 - protein, 10 aa, Artificial Sequence
  Description of Artificial Sequence: Synthetic peptide
GFTFSSYWMS

SEQ ID NO: 3550 - protein, 10 aa, Artificial Sequence
  Description of Artificial Sequence: Synthetic peptide
NINQDGSDKY

SEQ ID NO: 3551 - protein, 10 aa, Artificial Sequence
  Description of Artificial Sequence: Synthetic peptide
EGGQWLTLDY

SEQ ID NO: 3552 - protein, 12 aa, Artificial Sequence
  Description of Artificial Sequence: Synthetic peptide
RASQSVSSTYLA

SEQ ID NO: 3553 - protein, 7 aa, Artificial Sequence
  Description of Artificial Sequence: Synthetic peptide
GASSRAT

SEQ ID NO: 3554 - protein, 9 aa, Artificial Sequence
  Description of Artificial Sequence: Synthetic peptide
QQYGSSPFT

SEQ ID NO: 3555 - protein, 6 aa, Artificial Sequence
  Description of Artificial Sequence: Synthetic peptide
SSYWMS

SEQ ID NO: 3556 - protein, 13 aa, Artificial Sequence
  Description of Artificial Sequence: Synthetic peptide
WVANINQDGSDKY

SEQ ID NO: 3557 - protein, 11 aa, Artificial Sequence
  Description of Artificial Sequence: Synthetic peptide
AREGGQWLTLD

SEQ ID NO: 3558 - protein, 8 aa, Artificial Sequence
  Description of Artificial Sequence: Synthetic peptide
SSTYLAWY

SEQ ID NO: 3559 - protein, 10 aa, Artificial Sequence
  Description of Artificial Sequence: Synthetic peptide
LLIFGASSRA

SEQ ID NO: 3560 - protein, 8 aa, Artificial Sequence
  Description of Artificial Sequence: Synthetic peptide
QQYGSSPF

SEQ ID NO: 3561 - protein, 8 aa, Artificial Sequence
  Description of Artificial Sequence: Synthetic peptide
GFTFSSYW

SEQ ID NO: 3562 - protein, 8 aa, Artificial Sequence
  Description of Artificial Sequence: Synthetic peptide
INQDGSDK

SEQ ID NO: 3563 - protein, 12 aa, Artificial Sequence
  Description of Artificial Sequence: Synthetic peptide
AREGGQWLTLDY

SEQ ID NO: 3564 - protein, 7 aa, Artificial Sequence
  Description of Artificial Sequence: Synthetic peptide
QSVSSTY

SEQ ID NO: 3565 - protein, 3 aa, Artificial Sequence
  Description of Artificial Sequence: Synthetic peptide
GAS

SEQ ID NO: 3566 - protein, 9 aa, Artificial Sequence
  Description of Artificial Sequence: Synthetic peptide
QQYGSSPFT

SEQ ID NO: 3567 - protein, 119 aa, Artificial Sequence
  Description of Artificial Sequence: Synthetic polypeptide
EVQLVESGGGLVQPGGSLRLSCAASGFTFSSYWMSWVRQAPGKGLEWVANINQDGSDKYYVDSVKGRFTISRDNVKNSLYLQINSLRAEDTAVYYCAREGGQWLTLDYWGQGTLVTVSS

SEQ ID NO: 3568 - protein, 108 aa, Artificial Sequence; identical to SEQ ID NO: 3466
  Description of Artificial Sequence: Synthetic polypeptide

SEQ ID NO: 3569-3570 - skipped (2 entries)

SEQ ID NO: 3571 - protein, 5 aa, Artificial Sequence
  Description of Artificial Sequence: Synthetic peptide
DYYWS

SEQ ID NO: 3572 - protein, 16 aa, Artificial Sequence
  Description of Artificial Sequence: Synthetic peptide
RIYSSGSTNYNPSLKS

SEQ ID NO: 3573 - protein, 12 aa, Artificial Sequence
  Description of Artificial Sequence: Synthetic peptide
DREDYYYYGMDV

SEQ ID NO: 3574 - protein, 11 aa, Artificial Sequence
  Description of Artificial Sequence: Synthetic peptide
QASHDISNYLN

SEQ ID NO: 3575 - protein, 7 aa, Artificial Sequence
  Description of Artificial Sequence: Synthetic peptide
AASNLET

SEQ ID NO: 3576 - protein, 9 aa, Artificial Sequence
  Description of Artificial Sequence: Synthetic peptide
QQYDHLPLT

SEQ ID NO: 3577 - protein, 7 aa, Artificial Sequence
  Description of Artificial Sequence: Synthetic peptide
GGSISDY

SEQ ID NO: 3578 - protein, 5 aa, Artificial Sequence
  Description of Artificial Sequence: Synthetic peptide
YSSGS

SEQ ID NO: 3579 - protein, 11 aa, Artificial Sequence
  Description of Artificial Sequence: Synthetic peptide
DREDYYYYGMD

SEQ ID NO: 3580 - protein, 7 aa, Artificial Sequence
  Description of Artificial Sequence: Synthetic peptide
SHDISNY

SEQ ID NO: 3581 - protein, 3 aa, Artificial Sequence
  Description of Artificial Sequence: Synthetic peptide
AAS

SEQ ID NO: 3582 - protein, 6 aa, Artificial Sequence
  Description of Artificial Sequence: Synthetic peptide
YDHLPL

SEQ ID NO: 3583 - protein, 10 aa, Artificial Sequence
  Description of Artificial Sequence: Synthetic peptide
GGSISDYYWS

SEQ ID NO: 3584 - protein, 9 aa, Artificial Sequence
  Description of Artificial Sequence: Synthetic peptide
RIYSSGSTN

SEQ ID NO: 3585 - protein, 12 aa, Artificial Sequence
  Description of Artificial Sequence: Synthetic peptide
DREDYYYYGMDV

SEQ ID NO: 3586 - protein, 11 aa, Artificial Sequence
  Description of Artificial Sequence: Synthetic peptide
QASHDISNYLN

SEQ ID NO: 3587 - protein, 7 aa, Artificial Sequence
  Description of Artificial Sequence: Synthetic peptide
AASNLET

SEQ ID NO: 3588 - protein, 9 aa, Artificial Sequence
  Description of Artificial Sequence: Synthetic peptide
QQYDHLPLT

SEQ ID NO: 3589 - protein, 6 aa, Artificial Sequence
  Description of Artificial Sequence: Synthetic peptide
SDYYWS

SEQ ID NO: 3590 - protein, 12 aa, Artificial Sequence
  Description of Artificial Sequence: Synthetic peptide
WIGRIYSSGSTN

SEQ ID NO: 3591 - protein, 13 aa, Artificial Sequence
  Description of Artificial Sequence: Synthetic peptide
ARDREDYYYYGMD

SEQ ID NO: 3592 - protein, 7 aa, Artificial Sequence
  Description of Artificial Sequence: Synthetic peptide
SNYLNWY

SEQ ID NO: 3593 - protein, 10 aa, Artificial Sequence
  Description of Artificial Sequence: Synthetic peptide
LLIYAASNLE

SEQ ID NO: 3594 - protein, 8 aa, Artificial Sequence
  Description of Artificial Sequence: Synthetic peptide
QQYDHLPL

SEQ ID NO: 3595 - protein, 8 aa, Artificial Sequence
  Description of Artificial Sequence: Synthetic peptide
GGSISDYY

SEQ ID NO: 3596 - protein, 7 aa, Artificial Sequence
  Description of Artificial Sequence: Synthetic peptide
IYSSGST

SEQ ID NO: 3597 - protein, 14 aa, Artificial Sequence
  Description of Artificial Sequence: Synthetic peptide
ARDREDYYYYGMDV

SEQ ID NO: 3598 - protein, 6 aa, Artificial Sequence
  Description of Artificial Sequence: Synthetic peptide
HDISNY

SEQ ID NO: 3599 - protein, 3 aa, Artificial Sequence
  Description of Artificial Sequence: Synthetic peptide
AAS

SEQ ID NO: 3600 - protein, 9 aa, Artificial Sequence
  Description of Artificial Sequence: Synthetic peptide
QQYDHLPLT

SEQ ID NO: 3601 - protein, 120 aa, Artificial Sequence
  Description of Artificial Sequence: Synthetic polypeptide
QVQLQESGPGLVTPSETLSLSCTVSGGSISDYYWSWIRQPGGKGLEWIGRIYSSGSTNYNPSLKSRVTMSVDTSKNQFSLKLSSVTAADTAVYFCARDREDYYYYGMDVWGQGTTVTVSS

SEQ ID NO: 3602 - protein, 107 aa, Artificial Sequence
  Description of Artificial Sequence: Synthetic polypeptide
DIQMTQSPSSLSASVGDRVTITCQASHDISNYLNWYQQKPGKAPKLLIYAASNLETGVPSRFSGSGSGTDFSFTISSLQPEDIATYYCQQYDHLPLTFGGGTKVEIK

SEQ ID NO: 3603-3604 - skipped (2 entries)

SEQ ID NO: 3605 - protein, 5 aa, Artificial Sequence
  Description of Artificial Sequence: Synthetic peptide
GYYWS

SEQ ID NO: 3606 - protein, 16 aa, Artificial Sequence
  Description of Artificial Sequence: Synthetic peptide
EINHSGSTNYNPSLKS

SEQ ID NO: 3607 - protein, 7 aa, Artificial Sequence
  Description of Artificial Sequence: Synthetic peptide
VLNWFDP

SEQ ID NO: 3608 - protein, 11 aa, Artificial Sequence
  Description of Artificial Sequence: Synthetic peptide
RASQDIADWLA

SEQ ID NO: 3609 - protein, 7 aa, Artificial Sequence
  Description of Artificial Sequence: Synthetic peptide
AASSFQS

SEQ ID NO: 3610 - protein, 9 aa, Artificial Sequence
  Description of Artificial Sequence: Synthetic peptide
QQANSFPYT

SEQ ID NO: 3611 - protein, 7 aa, Artificial Sequence
  Description of Artificial Sequence: Synthetic peptide
GGSFSGY

SEQ ID NO: 3612 - protein, 5 aa, Artificial Sequence
  Description of Artificial Sequence: Synthetic peptide
NHSGS

SEQ ID NO: 3613 - protein, 6 aa, Artificial Sequence
  Description of Artificial Sequence: Synthetic peptide
VLNWFD

SEQ ID NO: 3614 - protein, 7 aa, Artificial Sequence
  Description of Artificial Sequence: Synthetic peptide
SQDIADW

SEQ ID NO: 3615 - protein, 3 aa, Artificial Sequence
  Description of Artificial Sequence: Synthetic peptide
AAS

SEQ ID NO: 3616 - protein, 6 aa, Artificial Sequence
  Description of Artificial Sequence: Synthetic peptide
ANSFPY

SEQ ID NO: 3617 - protein, 10 aa, Artificial Sequence
  Description of Artificial Sequence: Synthetic peptide
GGSFSGYYWS

SEQ ID NO: 3618 - protein, 9 aa, Artificial Sequence
  Description of Artificial Sequence: Synthetic peptide
EINHSGSTN

SEQ ID NO: 3619 - protein, 7 aa, Artificial Sequence
  Description of Artificial Sequence: Synthetic peptide
VLNWFDP

SEQ ID NO: 3620 - protein, 11 aa, Artificial Sequence
  Description of Artificial Sequence: Synthetic peptide
RASQDIADWLA

SEQ ID NO: 3621 - protein, 7 aa, Artificial Sequence
  Description of Artificial Sequence: Synthetic peptide
AASSFQS

SEQ ID NO: 3622 - protein, 9 aa, Artificial Sequence
  Description of Artificial Sequence: Synthetic peptide
QQANSFPYT

SEQ ID NO: 3623 - protein, 6 aa, Artificial Sequence
  Description of Artificial Sequence: Synthetic peptide
SGYYWS

SEQ ID NO: 3624 - protein, 12 aa, Artificial Sequence
  Description of Artificial Sequence: Synthetic peptide
WIGEINHSGSTN

SEQ ID NO: 3625 - protein, 8 aa, Artificial Sequence
  Description of Artificial Sequence: Synthetic peptide
ARVLNWFD

SEQ ID NO: 3626 - protein, 7 aa, Artificial Sequence
  Description of Artificial Sequence: Synthetic peptide
ADWLAWY

SEQ ID NO: 3627 - protein, 10 aa, Artificial Sequence
  Description of Artificial Sequence: Synthetic peptide
LLIYAASSFQ

SEQ ID NO: 3628 - protein, 8 aa, Artificial Sequence
  Description of Artificial Sequence: Synthetic peptide
QQANSFPY

SEQ ID NO: 3629 - protein, 8 aa, Artificial Sequence
  Description of Artificial Sequence: Synthetic peptide
GGSFSGYY

SEQ ID NO: 3630 - protein, 7 aa, Artificial Sequence
  Description of Artificial Sequence: Synthetic peptide
INHSGST

SEQ ID NO: 3631 - protein, 9 aa, Artificial Sequence
  Description of Artificial Sequence: Synthetic peptide
ARVLNWFDP

SEQ ID NO: 3632 - protein, 6 aa, Artificial Sequence
  Description of Artificial Sequence: Synthetic peptide
QDIADW

SEQ ID NO: 3633 - protein, 3 aa, Artificial Sequence
  Description of Artificial Sequence: Synthetic peptide
AAS

SEQ ID NO: 3634 - protein, 9 aa, Artificial Sequence
  Description of Artificial Sequence: Synthetic peptide
QQANSFPYT

SEQ ID NO: 3635 - protein, 115 aa, Artificial Sequence
  Description of Artificial Sequence: Synthetic polypeptide
QVQLQQWGAGLLKPSETLSLTCAVYGGSFSGYYWSWIRQPPGKGLEWIGEINHSGSTNYNPSLKSRVTISVVTSKNQFSLKLSSVTAADTAVYYCARVLNWFDPWGQGTLVTVSS

SEQ ID NO: 3636 - protein, 107 aa, Artificial Sequence
  Description of Artificial Sequence: Synthetic polypeptide
DIQMTQSPSSVSASVGDRVTITCRASQDIADWLAWYQQKPGKAPKLLIYAASSFQSGVPSRFSGSGSGTDFTLTISSLQPEDFATYFCQQANSFPYTFGQGTKLEIK

SEQ ID NO: 3637-3638 - skipped (2 entries)

SEQ ID NO: 3639 - protein, 5 aa, Artificial Sequence
  Description of Artificial Sequence: Synthetic peptide
NYFWS

SEQ ID NO: 3640 - protein, 16 aa, Artificial Sequence
  Description of Artificial Sequence: Synthetic peptide
RIYSSGNTNYNPSLKS

SEQ ID NO: 3641 - protein, 12 aa, Artificial Sequence
  Description of Artificial Sequence: Synthetic peptide
DREDYYYYGMDV

SEQ ID NO: 3642 - protein, 11 aa, Artificial Sequence
  Description of Artificial Sequence: Synthetic peptide
QASQDISNYLN

SEQ ID NO: 3643 - protein, 7 aa, Artificial Sequence
  Description of Artificial Sequence: Synthetic peptide
GASILET

SEQ ID NO: 3644 - protein, 9 aa, Artificial Sequence
  Description of Artificial Sequence: Synthetic peptide
QQYDSLPIT

SEQ ID NO: 3645 - protein, 7 aa, Artificial Sequence
  Description of Artificial Sequence: Synthetic peptide
GGSISNY

SEQ ID NO: 3646 - protein, 5 aa, Artificial Sequence
  Description of Artificial Sequence: Synthetic peptide
YSSGN

SEQ ID NO: 3647 - protein, 11 aa, Artificial Sequence
  Description of Artificial Sequence: Synthetic peptide
DREDYYYYGMD

SEQ ID NO: 3648 - protein, 7 aa, Artificial Sequence
  Description of Artificial Sequence: Synthetic peptide
SQDISNY

SEQ ID NO: 3649 - protein, 3 aa, Artificial Sequence
  Description of Artificial Sequence: Synthetic peptide
GAS

SEQ ID NO: 3650 - protein, 6 aa, Artificial Sequence
  Description of Artificial Sequence: Synthetic peptide
YDSLPI

SEQ ID NO: 3651 - protein, 10 aa, Artificial Sequence
  Description of Artificial Sequence: Synthetic peptide
GGSISNYFWS

SEQ ID NO: 3652 - protein, 9 aa, Artificial Sequence
  Description of Artificial Sequence: Synthetic peptide
RIYSSGNTN

SEQ ID NO: 3653 - protein, 12 aa, Artificial Sequence
  Description of Artificial Sequence: Synthetic peptide
DREDYYYYGMDV

SEQ ID NO: 3654 - protein, 11 aa, Artificial Sequence
  Description of Artificial Sequence: Synthetic peptide
QASQDISNYLN

SEQ ID NO: 3655 - protein, 7 aa, Artificial Sequence
  Description of Artificial Sequence: Synthetic peptide
GASILET

SEQ ID NO: 3656 - protein, 9 aa, Artificial Sequence
  Description of Artificial Sequence: Synthetic peptide
QQYDSLPIT

SEQ ID NO: 3657 - protein, 6 aa, Artificial Sequence
  Description of Artificial Sequence: Synthetic peptide
SNYFWS

SEQ ID NO: 3658 - protein, 12 aa, Artificial Sequence
  Description of Artificial Sequence: Synthetic peptide
WIGRIYSSGNTN

SEQ ID NO: 3659 - protein, 13 aa, Artificial Sequence
  Description of Artificial Sequence: Synthetic peptide
ARDREDYYYYGMD

SEQ ID NO: 3660 - protein, 7 aa, Artificial Sequence
  Description of Artificial Sequence: Synthetic peptide
SNYLNWY

SEQ ID NO: 3661 - protein, 10 aa, Artificial Sequence
  Description of Artificial Sequence: Synthetic peptide
LLIYGASILE

SEQ ID NO: 3662 - protein, 8 aa, Artificial Sequence
  Description of Artificial Sequence: Synthetic peptide
QQYDSLPI

SEQ ID NO: 3663 - protein, 8 aa, Artificial Sequence
  Description of Artificial Sequence: Synthetic peptide
GGSISNYF

SEQ ID NO: 3664 - protein, 7 aa, Artificial Sequence
  Description of Artificial Sequence: Synthetic peptide
IYSSGNT

SEQ ID NO: 3665 - protein, 14 aa, Artificial Sequence
  Description of Artificial Sequence: Synthetic peptide
ARDREDYYYYGMDV

SEQ ID NO: 3666 - protein, 6 aa, Artificial Sequence
  Description of Artificial Sequence: Synthetic peptide
QDISNY

SEQ ID NO: 3667 - protein, 3 aa, Artificial Sequence
  Description of Artificial Sequence: Synthetic peptide
GAS

SEQ ID NO: 3668 - protein, 9 aa, Artificial Sequence
  Description of Artificial Sequence: Synthetic peptide
QQYDSLPIT

SEQ ID NO: 3669 - protein, 120 aa, Artificial Sequence
  Description of Artificial Sequence: Synthetic polypeptide
QVQLQESGPGLVKPSETLSLTCTVSGGSISNYFWSWIRQPAGKGLEWIGRIYSSGNTNYNPSLKSRVTMSVDTSKNQFSLKLSSVTAADTAVYYCARDREDYYYYGMDVWGQGTTVTVSS

SEQ ID NO: 3670 - protein, 107 aa, Artificial Sequence
  Description of Artificial Sequence: Synthetic polypeptide
DIQMTQSPSSLSASVGDRVTITCQASQDISNYLNWYQQKPGKAPKLLIYGASILETGVPSRFTGSGSGTDFTFTISSLQPEDIATYYCQQYDSLPITFGQGTRLEIK

SEQ ID NO: 3671-3672 - skipped (2 entries)

SEQ ID NO: 3673 - protein, 5 aa, Artificial Sequence
  Description of Artificial Sequence: Synthetic peptide
SYYWS

SEQ ID NO: 3674 - protein, 16 aa, Artificial Sequence
  Description of Artificial Sequence: Synthetic peptide
RIYISGSTNYNPSLKS

SEQ ID NO: 3675 - protein, 12 aa, Artificial Sequence
  Description of Artificial Sequence: Synthetic peptide
ELERPYYYGMDV

SEQ ID NO: 3676 - protein, 11 aa, Artificial Sequence
  Description of Artificial Sequence: Synthetic peptide
QASQDISNYLN

SEQ ID NO: 3677 - protein, 7 aa, Artificial Sequence
  Description of Artificial Sequence: Synthetic peptide
NASTLET

SEQ ID NO: 3678 - protein, 9 aa, Artificial Sequence
  Description of Artificial Sequence: Synthetic peptide
QQYDNLPLT

SEQ ID NO: 3679 - protein, 7 aa, Artificial Sequence
  Description of Artificial Sequence: Synthetic peptide
GGSISSY

SEQ ID NO: 3680 - protein, 5 aa, Artificial Sequence
  Description of Artificial Sequence: Synthetic peptide
YISGS

SEQ ID NO: 3681 - protein, 11 aa, Artificial Sequence
  Description of Artificial Sequence: Synthetic peptide
ELERPYYYGMD

SEQ ID NO: 3682 - protein, 7 aa, Artificial Sequence
  Description of Artificial Sequence: Synthetic peptide
SQDISNY

SEQ ID NO: 3683 - protein, 3 aa, Artificial Sequence
  Description of Artificial Sequence: Synthetic peptide
NAS

SEQ ID NO: 3684 - protein, 6 aa, Artificial Sequence
  Description of Artificial Sequence: Synthetic peptide
YDNLPL

SEQ ID NO: 3685 - protein, 10 aa, Artificial Sequence
  Description of Artificial Sequence: Synthetic peptide
GGSISSYYWS

SEQ ID NO: 3686 - protein, 9 aa, Artificial Sequence
  Description of Artificial Sequence: Synthetic peptide
RIYISGSTN

SEQ ID NO: 3687 - protein, 12 aa, Artificial Sequence
  Description of Artificial Sequence: Synthetic peptide
ELERPYYYGMDV

SEQ ID NO: 3688 - protein, 11 aa, Artificial Sequence
  Description of Artificial Sequence: Synthetic peptide
QASQDISNYLN

SEQ ID NO: 3689 - protein, 7 aa, Artificial Sequence
  Description of Artificial Sequence: Synthetic peptide
NASTLET

SEQ ID NO: 3690 - protein, 9 aa, Artificial Sequence
  Description of Artificial Sequence: Synthetic peptide
QQYDNLPLT

SEQ ID NO: 3691 - protein, 6 aa, Artificial Sequence
  Description of Artificial Sequence: Synthetic peptide
SSYYWS

SEQ ID NO: 3692 - protein, 12 aa, Artificial Sequence
  Description of Artificial Sequence: Synthetic peptide
WIGRIYISGSTN

SEQ ID NO: 3693 - protein, 13 aa, Artificial Sequence
  Description of Artificial Sequence: Synthetic peptide
ARELERPYYYGMD

SEQ ID NO: 3694 - protein, 7 aa, Artificial Sequence
  Description of Artificial Sequence: Synthetic peptide
SNYLNWY

SEQ ID NO: 3695 - protein, 10 aa, Artificial Sequence
  Description of Artificial Sequence: Synthetic peptide
LLIYNASTLE

SEQ ID NO: 3696 - protein, 8 aa, Artificial Sequence
  Description of Artificial Sequence: Synthetic peptide
QQYDNLPL

SEQ ID NO: 3697 - protein, 8 aa, Artificial Sequence
  Description of Artificial Sequence: Synthetic peptide
GGSISSYY

SEQ ID NO: 3698 - protein, 7 aa, Artificial Sequence
  Description of Artificial Sequence: Synthetic peptide
IYISGST

SEQ ID NO: 3699 - protein, 14 aa, Artificial Sequence
  Description of Artificial Sequence: Synthetic peptide
ARELERPYYYGMDV

SEQ ID NO: 3700 - protein, 6 aa, Artificial Sequence
  Description of Artificial Sequence: Synthetic peptide
QDISNY

SEQ ID NO: 3701 - protein, 3 aa, Artificial Sequence
  Description of Artificial Sequence: Synthetic peptide
NAS

SEQ ID NO: 3702 - protein, 9 aa, Artificial Sequence
  Description of Artificial Sequence: Synthetic peptide
QQYDNLPLT

SEQ ID NO: 3703 - protein, 120 aa, Artificial Sequence
  Description of Artificial Sequence: Synthetic polypeptide
QVQLLESGPGLVKPSETLSLTCTVSGGSISSYYWSWIRQPAGKGLEWIGRIYISGSTNYNPSLKSRVTMSIDTSENQFSLNLSSVTAADTAVYYCARELERPYYYGMDVWGQGTTVTVSS

SEQ ID NO: 3704 - protein, 107 aa, Artificial Sequence
  Description of Artificial Sequence: Synthetic polypeptide
DIQMTQSPSSLSASVGDRVTITCQASQDISNYLNWYQQKPGKAPKLLIYNASTLETGVPSRFSGSGSGTDFTFTISSLQPEDIATYYCQQYDNLPLTFGGGTKVEFK

SEQ ID NO: 3705-3706 - skipped (2 entries)

SEQ ID NO: 3707 - protein, 5 aa, Artificial Sequence
  Description of Artificial Sequence: Synthetic peptide
TYYWS

SEQ ID NO: 3708 - protein, 16 aa, Artificial Sequence
  Description of Artificial Sequence: Synthetic peptide
RINTSGSTTYNPSLKS

SEQ ID NO: 3709 - protein, 12 aa, Artificial Sequence
  Description of Artificial Sequence: Synthetic peptide
ELERYYYYGMDV

SEQ ID NO: 3710 - protein, 11 aa, Artificial Sequence
  Description of Artificial Sequence: Synthetic peptide
QASQDISNYLN

SEQ ID NO: 3711 - protein, 7 aa, Artificial Sequence
  Description of Artificial Sequence: Synthetic peptide
YASILET

SEQ ID NO: 3712 - protein, 9 aa, Artificial Sequence
  Description of Artificial Sequence: Synthetic peptide
QQYDSLPLT

SEQ ID NO: 3713 - protein, 7 aa, Artificial Sequence
  Description of Artificial Sequence: Synthetic peptide
GGSISTY

SEQ ID NO: 3714 - protein, 5 aa, Artificial Sequence
  Description of Artificial Sequence: Synthetic peptide
NTSGS

SEQ ID NO: 3715 - protein, 11 aa, Artificial Sequence
  Description of Artificial Sequence: Synthetic peptide
ELERYYYYGMD

SEQ ID NO: 3716 - protein, 7 aa, Artificial Sequence
  Description of Artificial Sequence: Synthetic peptide
SQDISNY

SEQ ID NO: 3717 - protein, 3 aa, Artificial Sequence
  Description of Artificial Sequence: Synthetic peptide
YAS

SEQ ID NO: 3718 - protein, 6 aa, Artificial Sequence
  Description of Artificial Sequence: Synthetic peptide
YDSLPL

SEQ ID NO: 3719 - protein, 10 aa, Artificial Sequence
  Description of Artificial Sequence: Synthetic peptide
GGSISTYYWS

SEQ ID NO: 3720 - protein, 9 aa, Artificial Sequence
  Description of Artificial Sequence: Synthetic peptide
RINTSGSTT

SEQ ID NO: 3721 - protein, 12 aa, Artificial Sequence
  Description of Artificial Sequence: Synthetic peptide
ELERYYYYGMDV

SEQ ID NO: 3722 - protein, 11 aa, Artificial Sequence
  Description of Artificial Sequence: Synthetic peptide
QASQDISNYLN

SEQ ID NO: 3723 - protein, 7 aa, Artificial Sequence
  Description of Artificial Sequence: Synthetic peptide
YASILET

SEQ ID NO: 3724 - protein, 9 aa, Artificial Sequence
  Description of Artificial Sequence: Synthetic peptide
QQYDSLPLT

SEQ ID NO: 3725 - protein, 6 aa, Artificial Sequence
  Description of Artificial Sequence: Synthetic peptide
STYYWS

SEQ ID NO: 3726 - protein, 12 aa, Artificial Sequence
  Description of Artificial Sequence: Synthetic peptide
WIGRINTSGSTT

SEQ ID NO: 3727 - protein, 13 aa, Artificial Sequence
  Description of Artificial Sequence: Synthetic peptide
ARELERYYYYGMD

SEQ ID NO: 3728 - protein, 7 aa, Artificial Sequence
  Description of Artificial Sequence: Synthetic peptide
SNYLNWY

SEQ ID NO: 3729 - protein, 10 aa, Artificial Sequence
  Description of Artificial Sequence: Synthetic peptide
LLIYYASILE

SEQ ID NO: 3730 - protein, 8 aa, Artificial Sequence
  Description of Artificial Sequence: Synthetic peptide
QQYDSLPL

SEQ ID NO: 3731 - protein, 8 aa, Artificial Sequence
  Description of Artificial Sequence: Synthetic peptide
GGSISTYY

SEQ ID NO: 3732 - protein, 7 aa, Artificial Sequence
  Description of Artificial Sequence: Synthetic peptide
INTSGST

SEQ ID NO: 3733 - protein, 14 aa, Artificial Sequence
  Description of Artificial Sequence: Synthetic peptide
ARELERYYYYGMDV

SEQ ID NO: 3734 - protein, 6 aa, Artificial Sequence
  Description of Artificial Sequence: Synthetic peptide
QDISNY

SEQ ID NO: 3735 - protein, 3 aa, Artificial Sequence
  Description of Artificial Sequence: Synthetic peptide
YAS

SEQ ID NO: 3736 - protein, 9 aa, Artificial Sequence
  Description of Artificial Sequence: Synthetic peptide
QQYDSLPLT

SEQ ID NO: 3737 - protein, 120 aa, Artificial Sequence
  Description of Artificial Sequence: Synthetic polypeptide
QVQLQESGPGLVKPSETLSLTCTVSGGSISTYYWSWIRQPAGKGLEWIGRINTSGSTTYNPSLKSRVTMSVDTSKNQFSLKLSSVTAADTAVYYCARELERYYYYGMDVWGQGTTVTVSS

SEQ ID NO: 3738 - protein, 107 aa, Artificial Sequence
  Description of Artificial Sequence: Synthetic polypeptide
DIQMTQSPSSLSASVGDRVTITCQASQDISNYLNWYQQKPGKAPKLLIYYASILETGVPSRFSGSGSGTDFTFTISSLQPEDIATYYCQQYDSLPLTFGGGTKVEIK

SEQ ID NO: 3739-3740 - skipped (2 entries)

SEQ ID NO: 3741 - protein, 5 aa, Artificial Sequence
  Description of Artificial Sequence: Synthetic peptide
GYYWS

SEQ ID NO: 3742 - protein, 16 aa, Artificial Sequence
  Description of Artificial Sequence: Synthetic peptide
EINQSGSTNYNPSLKS

SEQ ID NO: 3743 - protein, 7 aa, Artificial Sequence
  Description of Artificial Sequence: Synthetic peptide
VINWFDS

SEQ ID NO: 3744 - protein, 11 aa, Artificial Sequence
  Description of Artificial Sequence: Synthetic peptide
RASQGISSWLA

SEQ ID NO: 3745 - protein, 7 aa, Artificial Sequence
  Description of Artificial Sequence: Synthetic peptide
DASSFQS

SEQ ID NO: 3746 - protein, 9 aa, Artificial Sequence
  Description of Artificial Sequence: Synthetic peptide
QQANSFPYT

SEQ ID NO: 3747 - protein, 7 aa, Artificial Sequence
  Description of Artificial Sequence: Synthetic peptide
GGSFSGY

SEQ ID NO: 3748 - protein, 5 aa, Artificial Sequence
  Description of Artificial Sequence: Synthetic peptide
NQSGS

SEQ ID NO: 3749 - protein, 6 aa, Artificial Sequence
  Description of Artificial Sequence: Synthetic peptide
VINWFD

SEQ ID NO: 3750 - protein, 7 aa, Artificial Sequence
  Description of Artificial Sequence: Synthetic peptide
SQGISSW

SEQ ID NO: 3751 - protein, 3 aa, Artificial Sequence
  Description of Artificial Sequence: Synthetic peptide
DAS

SEQ ID NO: 3752 - protein, 6 aa, Artificial Sequence
  Description of Artificial Sequence: Synthetic peptide
ANSFPY

SEQ ID NO: 3753 - protein, 10 aa, Artificial Sequence
  Description of Artificial Sequence: Synthetic peptide
GGSFSGYYWS

SEQ ID NO: 3754 - protein, 9 aa, Artificial Sequence
  Description of Artificial Sequence: Synthetic peptide
EINQSGSTN

SEQ ID NO: 3755 - protein, 7 aa, Artificial Sequence
  Description of Artificial Sequence: Synthetic peptide
VINWFDS

SEQ ID NO: 3756 - protein, 11 aa, Artificial Sequence
  Description of Artificial Sequence: Synthetic peptide
RASQGISSWLA

SEQ ID NO: 3757 - protein, 7 aa, Artificial Sequence
  Description of Artificial Sequence: Synthetic peptide
DASSFQS

SEQ ID NO: 3758 - protein, 9 aa, Artificial Sequence
  Description of Artificial Sequence: Synthetic peptide
QQANSFPYT

SEQ ID NO: 3759 - protein, 6 aa, Artificial Sequence
  Description of Artificial Sequence: Synthetic peptide
SGYYWS

SEQ ID NO: 3760 - protein, 12 aa, Artificial Sequence
  Description of Artificial Sequence: Synthetic peptide
WIGEINQSGSTN

SEQ ID NO: 3761 - protein, 8 aa, Artificial Sequence
  Description of Artificial Sequence: Synthetic peptide
ARVINWFD

SEQ ID NO: 3762 - protein, 7 aa, Artificial Sequence
  Description of Artificial Sequence: Synthetic peptide
SSWLAWY

SEQ ID NO: 3763 - protein, 10 aa, Artificial Sequence
  Description of Artificial Sequence: Synthetic peptide
LLIYDASSFQ

SEQ ID NO: 3764 - protein, 8 aa, Artificial Sequence
  Description of Artificial Sequence: Synthetic peptide
QQANSFPY

SEQ ID NO: 3765 - protein, 8 aa, Artificial Sequence
  Description of Artificial Sequence: Synthetic peptide
GGSFSGYY

SEQ ID NO: 3766 - protein, 7 aa, Artificial Sequence
  Description of Artificial Sequence: Synthetic peptide
INQSGST

SEQ ID NO: 3767 - protein, 9 aa, Artificial Sequence
  Description of Artificial Sequence: Synthetic peptide
ARVINWFDS

SEQ ID NO: 3768 - protein, 6 aa, Artificial Sequence
  Description of Artificial Sequence: Synthetic peptide
QGISSW

SEQ ID NO: 3769 - protein, 3 aa, Artificial Sequence
  Description of Artificial Sequence: Synthetic peptide
DAS

SEQ ID NO: 3770 - protein, 9 aa, Artificial Sequence
  Description of Artificial Sequence: Synthetic peptide
QQANSFPYT

SEQ ID NO: 3771 - protein, 115 aa, Artificial Sequence; identical to SEQ ID NO: 2853
  Description of Artificial Sequence: Synthetic polypeptide

SEQ ID NO: 3772 - protein, 107 aa, Artificial Sequence
  Description of Artificial Sequence: Synthetic polypeptide
DIQMTQSPSSVSASVGDRVTITCRASQGISSWLAWYQQKPGKAPKLLIYDASSFQSGVPSRFSGSGSGTDFTLTISSLQTDDFATYYCQQANSFPYTFGQGTKLEIK

SEQ ID NO: 3773-3774 - skipped (2 entries)

SEQ ID NO: 3775 - protein, 5 aa, Artificial Sequence
  Description of Artificial Sequence: Synthetic peptide
SYDMH

SEQ ID NO: 3776 - protein, 16 aa, Artificial Sequence
  Description of Artificial Sequence: Synthetic peptide
TIGTAGDTYYPGSVKG

SEQ ID NO: 3777 - protein, 10 aa, Artificial Sequence
  Description of Artificial Sequence: Synthetic peptide
GGYYYYGMDV

SEQ ID NO: 3778 - protein, 12 aa, Artificial Sequence
  Description of Artificial Sequence: Synthetic peptide
RASQSISSTYLA

SEQ ID NO: 3779 - protein, 7 aa, Artificial Sequence
  Description of Artificial Sequence: Synthetic peptide
GASSRAT

SEQ ID NO: 3780 - protein, 9 aa, Artificial Sequence
  Description of Artificial Sequence: Synthetic peptide
QQYGSSPFT

SEQ ID NO: 3781 - protein, 7 aa, Artificial Sequence
  Description of Artificial Sequence: Synthetic peptide
GFTFSSY

SEQ ID NO: 3782 - protein, 5 aa, Artificial Sequence
  Description of Artificial Sequence: Synthetic peptide
GTAGD

SEQ ID NO: 3783 - protein, 9 aa, Artificial Sequence
  Description of Artificial Sequence: Synthetic peptide
GGYYYYGMD

SEQ ID NO: 3784 - protein, 8 aa, Artificial Sequence
  Description of Artificial Sequence: Synthetic peptide
SQSISSTY

SEQ ID NO: 3785 - protein, 3 aa, Artificial Sequence
  Description of Artificial Sequence: Synthetic peptide
GAS

SEQ ID NO: 3786 - protein, 6 aa, Artificial Sequence
  Description of Artificial Sequence: Synthetic peptide
YGSSPF

SEQ ID NO: 3787 - protein, 10 aa, Artificial Sequence
  Description of Artificial Sequence: Synthetic peptide
GFTFSSYDMH

SEQ ID NO: 3788 - protein, 9 aa, Artificial Sequence
  Description of Artificial Sequence: Synthetic peptide
TIGTAGDTY

SEQ ID NO: 3789 - protein, 10 aa, Artificial Sequence
  Description of Artificial Sequence: Synthetic peptide
GGYYYYGMDV

SEQ ID NO: 3790 - protein, 12 aa, Artificial Sequence
  Description of Artificial Sequence: Synthetic peptide
RASQSISSTYLA

SEQ ID NO: 3791 - protein, 7 aa, Artificial Sequence
  Description of Artificial Sequence: Synthetic peptide
GASSRAT

SEQ ID NO: 3792 - protein, 9 aa, Artificial Sequence
  Description of Artificial Sequence: Synthetic peptide
QQYGSSPFT

SEQ ID NO: 3793 - protein, 6 aa, Artificial Sequence
  Description of Artificial Sequence: Synthetic peptide
SSYDMH

SEQ ID NO: 3794 - protein, 12 aa, Artificial Sequence
  Description of Artificial Sequence: Synthetic peptide
WVSTIGTAGDTY

SEQ ID NO: 3795 - protein, 11 aa, Artificial Sequence
  Description of Artificial Sequence: Synthetic peptide
ARGGYYYYGMD

SEQ ID NO: 3796 - protein, 8 aa, Artificial Sequence
  Description of Artificial Sequence: Synthetic peptide
SSTYLAWY

SEQ ID NO: 3797 - protein, 10 aa, Artificial Sequence
  Description of Artificial Sequence: Synthetic peptide
LLIYGASSRA

SEQ ID NO: 3798 - protein, 8 aa, Artificial Sequence
  Description of Artificial Sequence: Synthetic peptide
QQYGSSPF

SEQ ID NO: 3799 - protein, 8 aa, Artificial Sequence
  Description of Artificial Sequence: Synthetic peptide
GFTFSSYD

SEQ ID NO: 3800 - protein, 7 aa, Artificial Sequence
  Description of Artificial Sequence: Synthetic peptide
IGTAGDT

SEQ ID NO: 3801 - protein, 12 aa, Artificial Sequence
  Description of Artificial Sequence: Synthetic peptide
ARGGYYYYGMDV

SEQ ID NO: 3802 - protein, 7 aa, Artificial Sequence
  Description of Artificial Sequence: Synthetic peptide
QSISSTY

SEQ ID NO: 3803 - protein, 3 aa, Artificial Sequence
  Description of Artificial Sequence: Synthetic peptide
GAS

SEQ ID NO: 3804 - protein, 9 aa, Artificial Sequence
  Description of Artificial Sequence: Synthetic peptide
QQYGSSPFT

SEQ ID NO: 3805 - protein, 118 aa, Artificial Sequence
  Description of Artificial Sequence: Synthetic polypeptide
EVQLVESGGGLVQPGGSLRLSCAVSGFTFSSYDMHWVRQATGKGLEWVSTIGTAGDTYYPGSVKGRFTISRENAKKFLYLQMNSLRAGDTAVYYCARGGYYYYGMDVWGQGTTVTVSS

SEQ ID NO: 3806 - protein, 108 aa, Artificial Sequence
  Description of Artificial Sequence: Synthetic polypeptide
EIVLTQSPGTLSLSPGERATLSCRASQSISSTYLAWYQQKPGQAPRLLIYGASSRATGIPDRFSGSGSGTDFTLTISRLEPEDFAVYYCQQYGSSPFTFGPGTKVDIK

SEQ ID NO: 3807-3808 - skipped (2 entries)

SEQ ID NO: 3809 - protein, 5 aa, Artificial Sequence
  Description of Artificial Sequence: Synthetic peptide
SYWMS

SEQ ID NO: 3810 - protein, 17 aa, Artificial Sequence
  Description of Artificial Sequence: Synthetic peptide
NIKEEGSEKYYVDSVKG

SEQ ID NO: 3811 - protein, 10 aa, Artificial Sequence
  Description of Artificial Sequence: Synthetic peptide
EGGQWLALDY

SEQ ID NO: 3812 - protein, 11 aa, Artificial Sequence
  Description of Artificial Sequence: Synthetic peptide
RASQGISSWLA

SEQ ID NO: 3813 - protein, 7 aa, Artificial Sequence
  Description of Artificial Sequence: Synthetic peptide
GASSLQS

SEQ ID NO: 3814 - protein, 9 aa, Artificial Sequence
  Description of Artificial Sequence: Synthetic peptide
QQANSFPWT

SEQ ID NO: 3815 - protein, 7 aa, Artificial Sequence
  Description of Artificial Sequence: Synthetic peptide
GFTFSSY

SEQ ID NO: 3816 - protein, 6 aa, Artificial Sequence
  Description of Artificial Sequence: Synthetic peptide
KEEGSE

SEQ ID NO: 3817 - protein, 9 aa, Artificial Sequence
  Description of Artificial Sequence: Synthetic peptide
EGGQWLALD

SEQ ID NO: 3818 - protein, 7 aa, Artificial Sequence
  Description of Artificial Sequence: Synthetic peptide
SQGISSW

SEQ ID NO: 3819 - protein, 3 aa, Artificial Sequence
  Description of Artificial Sequence: Synthetic peptide
GAS

SEQ ID NO: 3820 - protein, 6 aa, Artificial Sequence
  Description of Artificial Sequence: Synthetic peptide
ANSFPW

SEQ ID NO: 3821 - protein, 10 aa, Artificial Sequence
  Description of Artificial Sequence: Synthetic peptide
GFTFSSYWMS

SEQ ID NO: 3822 - protein, 10 aa, Artificial Sequence
  Description of Artificial Sequence: Synthetic peptide
NIKEEGSEKY

SEQ ID NO: 3823 - protein, 10 aa, Artificial Sequence
  Description of Artificial Sequence: Synthetic peptide
EGGQWLALDY

SEQ ID NO: 3824 - protein, 11 aa, Artificial Sequence
  Description of Artificial Sequence: Synthetic peptide
RASQGISSWLA

SEQ ID NO: 3825 - protein, 7 aa, Artificial Sequence
  Description of Artificial Sequence: Synthetic peptide
GASSLQS

SEQ ID NO: 3826 - protein, 9 aa, Artificial Sequence
  Description of Artificial Sequence: Synthetic peptide
QQANSFPWT

SEQ ID NO: 3827 - protein, 6 aa, Artificial Sequence
  Description of Artificial Sequence: Synthetic peptide
SSYWMS

SEQ ID NO: 3828 - protein, 13 aa, Artificial Sequence
  Description of Artificial Sequence: Synthetic peptide
WVANIKEEGSEKY

SEQ ID NO: 3829 - protein, 11 aa, Artificial Sequence
  Description of Artificial Sequence: Synthetic peptide
VREGGQWLALD

SEQ ID NO: 3830 - protein, 7 aa, Artificial Sequence
  Description of Artificial Sequence: Synthetic peptide
SSWLAWY

SEQ ID NO: 3831 - protein, 10 aa, Artificial Sequence
  Description of Artificial Sequence: Synthetic peptide
LLIFGASSLQ

SEQ ID NO: 3832 - protein, 8 aa, Artificial Sequence
  Description of Artificial Sequence: Synthetic peptide
QQANSFPW

SEQ ID NO: 3833 - protein, 8 aa, Artificial Sequence
  Description of Artificial Sequence: Synthetic peptide
GFTFSSYW

SEQ ID NO: 3834 - protein, 8 aa, Artificial Sequence
  Description of Artificial Sequence: Synthetic peptide
IKEEGSEK

SEQ ID NO: 3835 - protein, 12 aa, Artificial Sequence
  Description of Artificial Sequence: Synthetic peptide
VREGGQWLALDY

SEQ ID NO: 3836 - protein, 6 aa, Artificial Sequence
  Description of Artificial Sequence: Synthetic peptide
QGISSW

SEQ ID NO: 3837 - protein, 3 aa, Artificial Sequence
  Description of Artificial Sequence: Synthetic peptide
GAS

SEQ ID NO: 3838 - protein, 9 aa, Artificial Sequence
  Description of Artificial Sequence: Synthetic peptide
QQANSFPWT

SEQ ID NO: 3839 - protein, 119 aa, Artificial Sequence
  Description of Artificial Sequence: Synthetic polypeptide
EVQVVESGGGLVQPGGSLRLSCAASGFTFSSYWMSWVRQAPGKGLEWVANIKEEGSEKYYVDSVKGRFTISRDNAKNSLYLQMNSLRAEDTAVYYCVREGGQWLALDYWGQGTLVTVSS

SEQ ID NO: 3840 - protein, 107 aa, Artificial Sequence
  Description of Artificial Sequence: Synthetic polypeptide
DIQMTQSPSSVSGSVGDRVTITCRASQGISSWLAWYQQKPGKAPKLLIFGASSLQSGVPSRFSGSGSGTDFTLTISSLQPEDFATYYCQQANSFPWTFGQGTKVQIK

SEQ ID NO: 3841-3842 - skipped (2 entries)

SEQ ID NO: 3843 - protein, 5 aa, Artificial Sequence
  Description of Artificial Sequence: Synthetic peptide
SYWMS

SEQ ID NO: 3844 - protein, 17 aa, Artificial Sequence
  Description of Artificial Sequence: Synthetic peptide
NIKEDGSEKYYVDSVKG

SEQ ID NO: 3845 - protein, 11 aa, Artificial Sequence
  Description of Artificial Sequence: Synthetic peptide
DGSYSGYGMDV

SEQ ID NO: 3846 - protein, 11 aa, Artificial Sequence
  Description of Artificial Sequence: Synthetic peptide
RASQGIRNDLG

SEQ ID NO: 3847 - protein, 7 aa, Artificial Sequence
  Description of Artificial Sequence: Synthetic peptide
AASSLQS

SEQ ID NO: 3848 - protein, 9 aa, Artificial Sequence
  Description of Artificial Sequence: Synthetic peptide
LLDYNYPYT

SEQ ID NO: 3849 - protein, 7 aa, Artificial Sequence
  Description of Artificial Sequence: Synthetic peptide
GFTFSSY

SEQ ID NO: 3850 - protein, 6 aa, Artificial Sequence
  Description of Artificial Sequence: Synthetic peptide
KEDGSE

SEQ ID NO: 3851 - protein, 10 aa, Artificial Sequence
  Description of Artificial Sequence: Synthetic peptide
DGSYSGYGMD

SEQ ID NO: 3852 - protein, 7 aa, Artificial Sequence
  Description of Artificial Sequence: Synthetic peptide
SQGIRND

SEQ ID NO: 3853 - protein, 3 aa, Artificial Sequence
  Description of Artificial Sequence: Synthetic peptide
AAS

SEQ ID NO: 3854 - protein, 6 aa, Artificial Sequence
  Description of Artificial Sequence: Synthetic peptide
DYNYPY

SEQ ID NO: 3855 - protein, 10 aa, Artificial Sequence
  Description of Artificial Sequence: Synthetic peptide
GFTFSSYWMS

SEQ ID NO: 3856 - protein, 10 aa, Artificial Sequence
  Description of Artificial Sequence: Synthetic peptide
NIKEDGSEKY

SEQ ID NO: 3857 - protein, 11 aa, Artificial Sequence
  Description of Artificial Sequence: Synthetic peptide
DGSYSGYGMDV

SEQ ID NO: 3858 - protein, 11 aa, Artificial Sequence
  Description of Artificial Sequence: Synthetic peptide
RASQGIRNDLG

SEQ ID NO: 3859 - protein, 7 aa, Artificial Sequence
  Description of Artificial Sequence: Synthetic peptide
AASSLQS

SEQ ID NO: 3860 - protein, 9 aa, Artificial Sequence
  Description of Artificial Sequence: Synthetic peptide
LLDYNYPYT

SEQ ID NO: 3861 - protein, 6 aa, Artificial Sequence
  Description of Artificial Sequence: Synthetic peptide
SSYWMS

SEQ ID NO: 3862 - protein, 13 aa, Artificial Sequence
  Description of Artificial Sequence: Synthetic peptide
WVANIKEDGSEKY

SEQ ID NO: 3863 - protein, 12 aa, Artificial Sequence
  Description of Artificial Sequence: Synthetic peptide
ARDGSYSGYGMD

SEQ ID NO: 3864 - protein, 7 aa, Artificial Sequence
  Description of Artificial Sequence: Synthetic peptide
RNDLGWY

SEQ ID NO: 3865 - protein, 10 aa, Artificial Sequence
  Description of Artificial Sequence: Synthetic peptide
LLIYAASSLQ

SEQ ID NO: 3866 - protein, 8 aa, Artificial Sequence
  Description of Artificial Sequence: Synthetic peptide
LLDYNYPY

SEQ ID NO: 3867 - protein, 8 aa, Artificial Sequence
  Description of Artificial Sequence: Synthetic peptide
GFTFSSYW

SEQ ID NO: 3868 - protein, 8 aa, Artificial Sequence
  Description of Artificial Sequence: Synthetic peptide
IKEDGSEK

SEQ ID NO: 3869 - protein, 13 aa, Artificial Sequence
  Description of Artificial Sequence: Synthetic peptide
ARDGSYSGYGMDV

SEQ ID NO: 3870 - protein, 6 aa, Artificial Sequence
  Description of Artificial Sequence: Synthetic peptide
QGIRND

SEQ ID NO: 3871 - protein, 3 aa, Artificial Sequence
  Description of Artificial Sequence: Synthetic peptide
AAS

SEQ ID NO: 3872 - protein, 9 aa, Artificial Sequence
  Description of Artificial Sequence: Synthetic peptide
LLDYNYPYT

SEQ ID NO: 3873 - protein, 120 aa, Artificial Sequence
  Description of Artificial Sequence: Synthetic polypeptide
EVQLVESGGGLVQPGGSLRLSCAASGFTFSSYWMSWVRQAPGKGLEWVANIKEDGSEKYYVDSVKGRFTISRDNAKNSLYLQMNSLRAEDTAVYYCARDGSYSGYGMDVWGQGTTVTVSS

SEQ ID NO: 3874 - protein, 107 aa, Artificial Sequence
  Description of Artificial Sequence: Synthetic polypeptide
AIQMTQSPSSLSASVGDRVTITCRASQGIRNDLGWYQQKPGKAPKLLIYAASSLQSGVPSRFSGRGSGTDFALTISSLQPEDFATYYCLLDYNYPYTFGQGTRLEIK

SEQ ID NO: 3875 - protein, 450 aa, Artificial Sequence
  Description of Artificial Sequence: Synthetic peptide
EVQLVESGGGLVQPGGSLRLSCAASGFTFSSYWMSWVRQAPGKGLEWVANIKEDGSEKYYVDSVKGRFTISRDNAKNSLYLQMNSLRAEDTAVYYCARDGSYSGYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3876 - protein, 214 aa, Artificial Sequence
  Description of Artificial Sequence: Synthetic peptide
AIQMTQSPSSLSASVGDRVTITCRASQGIRNDLGWYQQKPGKAPKLLIYAASSLQSGVPSRFSGRGSGTDFALTISSLQPEDFATYYCLLDYNYPYTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3877 - protein, 5 aa, Artificial Sequence
  Description of Artificial Sequence: Synthetic peptide
SYYYN

SEQ ID NO: 3878 - protein, 16 aa, Artificial Sequence
  Description of Artificial Sequence: Synthetic peptide
RIYTSGRTDYNPSLKS

SEQ ID NO: 3879 - protein, 10 aa, Artificial Sequence
  Description of Artificial Sequence: Synthetic peptide
DEGPTDAFDI

SEQ ID NO: 3880 - protein, 17 aa, Artificial Sequence
  Description of Artificial Sequence: Synthetic peptide
RSSQSLLDSDDGNTYLD

SEQ ID NO: 3881 - protein, 7 aa, Artificial Sequence
  Description of Artificial Sequence: Synthetic peptide
TLSYRAS

SEQ ID NO: 3882 - protein, 9 aa, Artificial Sequence
  Description of Artificial Sequence: Synthetic peptide
MQRIEFPFT

SEQ ID NO: 3883 - protein, 7 aa, Artificial Sequence
  Description of Artificial Sequence: Synthetic peptide
GGSISSY

SEQ ID NO: 3884 - protein, 5 aa, Artificial Sequence
  Description of Artificial Sequence: Synthetic peptide
YTSGR

SEQ ID NO: 3885 - protein, 9 aa, Artificial Sequence
  Description of Artificial Sequence: Synthetic peptide
DEGPTDAFD

SEQ ID NO: 3886 - protein, 13 aa, Artificial Sequence
  Description of Artificial Sequence: Synthetic peptide
SQSLLDSDDGNTY

SEQ ID NO: 3887 - protein, 3 aa, Artificial Sequence
  Description of Artificial Sequence: Synthetic peptide
TLS

SEQ ID NO: 3888 - protein, 6 aa, Artificial Sequence
  Description of Artificial Sequence: Synthetic peptide
RIEFPF

SEQ ID NO: 3889 - protein, 10 aa, Artificial Sequence
  Description of Artificial Sequence: Synthetic peptide
GGSISSYYYN

SEQ ID NO: 3890 - protein, 9 aa, Artificial Sequence
  Description of Artificial Sequence: Synthetic peptide
RIYTSGRTD

SEQ ID NO: 3891 - protein, 10 aa, Artificial Sequence
  Description of Artificial Sequence: Synthetic peptide
DEGPTDAFDI

SEQ ID NO: 3892 - protein, 17 aa, Artificial Sequence
  Description of Artificial Sequence: Synthetic peptide
RSSQSLLDSDDGNTYLD

SEQ ID NO: 3893 - protein, 7 aa, Artificial Sequence
  Description of Artificial Sequence: Synthetic peptide
TLSYRAS

SEQ ID NO: 3894 - protein, 9 aa, Artificial Sequence
  Description of Artificial Sequence: Synthetic peptide
MQRIEFPFT

SEQ ID NO: 3895 - protein, 6 aa, Artificial Sequence
  Description of Artificial Sequence: Synthetic peptide
SSYYYN

SEQ ID NO: 3896 - protein, 12 aa, Artificial Sequence
  Description of Artificial Sequence: Synthetic peptide
WIGRIYTSGRTD

SEQ ID NO: 3897 - protein, 11 aa, Artificial Sequence
  Description of Artificial Sequence: Synthetic peptide
ARDEGPTDAFD

SEQ ID NO: 3898 - protein, 13 aa, Artificial Sequence
  Description of Artificial Sequence: Synthetic peptide
LDSDDGNTYLDWY

SEQ ID NO: 3899 - protein, 10 aa, Artificial Sequence
  Description of Artificial Sequence: Synthetic peptide
LLIYTLSYRA

SEQ ID NO: 3900 - protein, 8 aa, Artificial Sequence
  Description of Artificial Sequence: Synthetic peptide
MQRIEFPF

SEQ ID NO: 3901 - protein, 8 aa, Artificial Sequence
  Description of Artificial Sequence: Synthetic peptide
GGSISSYY

SEQ ID NO: 3902 - protein, 7 aa, Artificial Sequence
  Description of Artificial Sequence: Synthetic peptide
IYTSGRT

SEQ ID NO: 3903 - protein, 12 aa, Artificial Sequence
  Description of Artificial Sequence: Synthetic peptide
ARDEGPTDAFDI

SEQ ID NO: 3904 - protein, 12 aa, Artificial Sequence
  Description of Artificial Sequence: Synthetic peptide
QSLLDSDDGNTY

SEQ ID NO: 3905 - protein, 3 aa, Artificial Sequence
  Description of Artificial Sequence: Synthetic peptide
TLS

SEQ ID NO: 3906 - protein, 9 aa, Artificial Sequence
  Description of Artificial Sequence: Synthetic peptide
MQRIEFPFT

SEQ ID NO: 3907 - protein, 118 aa, Artificial Sequence
  Description of Artificial Sequence: Synthetic polypeptide
QAQLQESGPGLVKPSETLSLTCTVSGGSISSYYYNWIRQPAGKGLEWIGRIYTSGRTDYNPSLKSRVTMSADTSKNQFSLKLSSVTAADTAVYYCARDEGPTDAFDIWGQGTMVTVSS

SEQ ID NO: 3908 - protein, 113 aa, Artificial Sequence
  Description of Artificial Sequence: Synthetic polypeptide
DIVMTQTPLSLPVTPGEPASISCRSSQSLLDSDDGNTYLDWYLQKPGQSPHLLIYTLSYRASGVPDRFSGSGSGSDFTLKISRVEAEDVGVYYCMQRIEFPFTFGPGTKVDIK

SEQ ID NO: 3909-3910 - skipped (2 entries)

SEQ ID NO: 3911 - protein, 5 aa, Artificial Sequence
  Description of Artificial Sequence: Synthetic peptide
SFYWS

SEQ ID NO: 3912 - protein, 16 aa, Artificial Sequence
  Description of Artificial Sequence: Synthetic peptide
RIYTSGSTNYNPSLKS

SEQ ID NO: 3913 - protein, 10 aa, Artificial Sequence
  Description of Artificial Sequence: Synthetic peptide
DPGYSDAFAI

SEQ ID NO: 3914 - protein, 11 aa, Artificial Sequence
  Description of Artificial Sequence: Synthetic peptide
QASQDISNYLT

SEQ ID NO: 3915 - protein, 7 aa, Artificial Sequence
  Description of Artificial Sequence: Synthetic peptide
DTSNLET

SEQ ID NO: 3916 - protein, 9 aa, Artificial Sequence
  Description of Artificial Sequence: Synthetic peptide
QQYDNLPLT

SEQ ID NO: 3917 - protein, 7 aa, Artificial Sequence
  Description of Artificial Sequence: Synthetic peptide
GVSSTSF

SEQ ID NO: 3918 - protein, 5 aa, Artificial Sequence
  Description of Artificial Sequence: Synthetic peptide
YTSGS

SEQ ID NO: 3919 - protein, 9 aa, Artificial Sequence
  Description of Artificial Sequence: Synthetic peptide
DPGYSDAFA

SEQ ID NO: 3920 - protein, 7 aa, Artificial Sequence
  Description of Artificial Sequence: Synthetic peptide
SQDISNY

SEQ ID NO: 3921 - protein, 3 aa, Artificial Sequence
  Description of Artificial Sequence: Synthetic peptide
DTS

SEQ ID NO: 3922 - protein, 6 aa, Artificial Sequence
  Description of Artificial Sequence: Synthetic peptide
YDNLPL

SEQ ID NO: 3923 - protein, 10 aa, Artificial Sequence
  Description of Artificial Sequence: Synthetic peptide
GVSSTSFYWS

SEQ ID NO: 3924 - protein, 9 aa, Artificial Sequence
  Description of Artificial Sequence: Synthetic peptide
RIYTSGSTN

SEQ ID NO: 3925 - protein, 10 aa, Artificial Sequence
  Description of Artificial Sequence: Synthetic peptide
DPGYSDAFAI

SEQ ID NO: 3926 - protein, 11 aa, Artificial Sequence
  Description of Artificial Sequence: Synthetic peptide
QASQDISNYLT

SEQ ID NO: 3927 - protein, 7 aa, Artificial Sequence
  Description of Artificial Sequence: Synthetic peptide
DTSNLET

SEQ ID NO: 3928 - protein, 9 aa, Artificial Sequence
  Description of Artificial Sequence: Synthetic peptide
QQYDNLPLT

SEQ ID NO: 3929 - protein, 6 aa, Artificial Sequence
  Description of Artificial Sequence: Synthetic peptide
TSFYWS

SEQ ID NO: 3930 - protein, 12 aa, Artificial Sequence
  Description of Artificial Sequence: Synthetic peptide
WIGRIYTSGSTN

SEQ ID NO: 3931 - protein, 11 aa, Artificial Sequence
  Description of Artificial Sequence: Synthetic peptide
ARDPGYSDAFA

SEQ ID NO: 3932 - protein, 7 aa, Artificial Sequence
  Description of Artificial Sequence: Synthetic peptide
SNYLTWY

SEQ ID NO: 3933 - protein, 10 aa, Artificial Sequence
  Description of Artificial Sequence: Synthetic peptide
LLIYDTSNLE

SEQ ID NO: 3934 - protein, 8 aa, Artificial Sequence
  Description of Artificial Sequence: Synthetic peptide
QQYDNLPL

SEQ ID NO: 3935 - protein, 8 aa, Artificial Sequence
  Description of Artificial Sequence: Synthetic peptide
GVSSTSFY

SEQ ID NO: 3936 - protein, 7 aa, Artificial Sequence
  Description of Artificial Sequence: Synthetic peptide
IYTSGST

SEQ ID NO: 3937 - protein, 12 aa, Artificial Sequence
  Description of Artificial Sequence: Synthetic peptide
ARDPGYSDAFAI

SEQ ID NO: 3938 - protein, 6 aa, Artificial Sequence
  Description of Artificial Sequence: Synthetic peptide
QDISNY

SEQ ID NO: 3939 - protein, 3 aa, Artificial Sequence
  Description of Artificial Sequence: Synthetic peptide
DTS

SEQ ID NO: 3940 - protein, 9 aa, Artificial Sequence
  Description of Artificial Sequence: Synthetic peptide
QQYDNLPLT

SEQ ID NO: 3941 - protein, 118 aa, Artificial Sequence
  Description of Artificial Sequence: Synthetic polypeptide
QVQLQESGPGLVKPSETLSLTCSVSGVSSTSFYWSWIRQPAGKGLDWIGRIYTSGSTNYNPSLKSRVTMSVDTSKNQFSLKLSSVTAADTAVYYCARDPGYSDAFAIWGQGTMVTVSS

SEQ ID NO: 3942 - protein, 107 aa, Artificial Sequence
  Description of Artificial Sequence: Synthetic polypeptide
DIQMTQSPSSLSASVGDRVTITCQASQDISNYLTWYQQKPGKAPKLLIYDTSNLETGVPSRFSGSGSGTDFTFTISSLQPEDIATYYCQQYDNLPLTFGGGTKVEIK

SEQ ID NO: 3943-3944 - skipped (2 entries)

SEQ ID NO: 3945 - protein, 5 aa, Artificial Sequence
  Description of Artificial Sequence: Synthetic peptide
SYWMS

SEQ ID NO: 3946 - protein, 17 aa, Artificial Sequence
  Description of Artificial Sequence: Synthetic peptide
NIKQDGSEKYYMDSVKG

SEQ ID NO: 3947 - protein, 11 aa, Artificial Sequence
  Description of Artificial Sequence: Synthetic peptide
DNSYYYYGMDV

SEQ ID NO: 3948 - protein, 11 aa, Artificial Sequence
  Description of Artificial Sequence: Synthetic peptide
RASQGIRDDLG

SEQ ID NO: 3949 - protein, 7 aa, Artificial Sequence
  Description of Artificial Sequence: Synthetic peptide
AASSLQS

SEQ ID NO: 3950 - protein, 9 aa, Artificial Sequence
  Description of Artificial Sequence: Synthetic peptide
LHHYNYPYT

SEQ ID NO: 3951 - protein, 7 aa, Artificial Sequence
  Description of Artificial Sequence: Synthetic peptide
GFIFSSY

SEQ ID NO: 3952 - protein, 6 aa, Artificial Sequence
  Description of Artificial Sequence: Synthetic peptide
KQDGSE

SEQ ID NO: 3953 - protein, 10 aa, Artificial Sequence
  Description of Artificial Sequence: Synthetic peptide
DNSYYYYGMD

SEQ ID NO: 3954 - protein, 7 aa, Artificial Sequence
  Description of Artificial Sequence: Synthetic peptide
SQGIRDD

SEQ ID NO: 3955 - protein, 3 aa, Artificial Sequence
  Description of Artificial Sequence: Synthetic peptide
AAS

SEQ ID NO: 3956 - protein, 6 aa, Artificial Sequence
  Description of Artificial Sequence: Synthetic peptide
HYNYPY

SEQ ID NO: 3957 - protein, 10 aa, Artificial Sequence
  Description of Artificial Sequence: Synthetic peptide
GFIFSSYWMS

SEQ ID NO: 3958 - protein, 10 aa, Artificial Sequence
  Description of Artificial Sequence: Synthetic peptide
NIKQDGSEKY

SEQ ID NO: 3959 - protein, 11 aa, Artificial Sequence
  Description of Artificial Sequence: Synthetic peptide
DNSYYYYGMDV

SEQ ID NO: 3960 - protein, 11 aa, Artificial Sequence
  Description of Artificial Sequence: Synthetic peptide
RASQGIRDDLG

SEQ ID NO: 3961 - protein, 7 aa, Artificial Sequence
  Description of Artificial Sequence: Synthetic peptide
AASSLQS

SEQ ID NO: 3962 - protein, 9 aa, Artificial Sequence
  Description of Artificial Sequence: Synthetic peptide
LHHYNYPYT

SEQ ID NO: 3963 - protein, 6 aa, Artificial Sequence
  Description of Artificial Sequence: Synthetic peptide
SSYWMS

SEQ ID NO: 3964 - protein, 13 aa, Artificial Sequence
  Description of Artificial Sequence: Synthetic peptide
WVANIKQDGSEKY

SEQ ID NO: 3965 - protein, 12 aa, Artificial Sequence
  Description of Artificial Sequence: Synthetic peptide
ARDNSYYYYGMD

SEQ ID NO: 3966 - protein, 7 aa, Artificial Sequence
  Description of Artificial Sequence: Synthetic peptide
RDDLGWY

SEQ ID NO: 3967 - protein, 10 aa, Artificial Sequence
  Description of Artificial Sequence: Synthetic peptide
LLIFAASSLQ

SEQ ID NO: 3968 - protein, 8 aa, Artificial Sequence
  Description of Artificial Sequence: Synthetic peptide
LHHYNYPY

SEQ ID NO: 3969 - protein, 8 aa, Artificial Sequence
  Description of Artificial Sequence: Synthetic peptide
GFIFSSYW

SEQ ID NO: 3970 - protein, 8 aa, Artificial Sequence
  Description of Artificial Sequence: Synthetic peptide
IKQDGSEK

SEQ ID NO: 3971 - protein, 13 aa, Artificial Sequence
  Description of Artificial Sequence: Synthetic peptide
ARDNSYYYYGMDV

SEQ ID NO: 3972 - protein, 6 aa, Artificial Sequence
  Description of Artificial Sequence: Synthetic peptide
QGIRDD

SEQ ID NO: 3973 - protein, 3 aa, Artificial Sequence
  Description of Artificial Sequence: Synthetic peptide
AAS

SEQ ID NO: 3974 - protein, 9 aa, Artificial Sequence
  Description of Artificial Sequence: Synthetic peptide
LHHYNYPYT

SEQ ID NO: 3975 - protein, 120 aa, Artificial Sequence
  Description of Artificial Sequence: Synthetic polypeptide
EVQLVESGGGLVQPGGSLRLSCAASGFIFSSYWMSWVRQAPGKGLEWVANIKQDGSEKYYMDSVKGRFTISRDNAKNSLYLQMNSLRAEDTAVYYCARDNSYYYYGMDVWGQGTTVTVSS

SEQ ID NO: 3976 - protein, 107 aa, Artificial Sequence
  Description of Artificial Sequence: Synthetic polypeptide
AIQMTQSPSSLSASVGDRVTITCRASQGIRDDLGWYQQKPGKAPKLLIFAASSLQSGVPSSFSGSGSGTDFTLTISSLQPEDFATYYCLHHYNYPYTFGQGTKLEIK

SEQ ID NO: 3977 - protein, 450 aa, Artificial Sequence
  Description of Artificial Sequence: Synthetic peptide
EVQLVESGGGLVQPGGSLRLSCAASGFIFSSYWMSWVRQAPGKGLEWVANIKQDGSEKYYMDSVKGRFTISRDNAKNSLYLQMNSLRAEDTAVYYCARDNSYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3978 - protein, 214 aa, Artificial Sequence
  Description of Artificial Sequence: Synthetic peptide
AIQMTQSPSSLSASVGDRVTITCRASQGIRDDLGWYQQKPGKAPKLLIFAASSLQSGVPSSFSGSGSGTDFTLTISSLQPEDFATYYCLHHYNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3979 - protein, 5 aa, Artificial Sequence
  Description of Artificial Sequence: Synthetic peptide
GFYWS

SEQ ID NO: 3980 - protein, 16 aa, Artificial Sequence
  Description of Artificial Sequence: Synthetic peptide
RIYTSENTNYNPSLKS

SEQ ID NO: 3981 - protein, 12 aa, Artificial Sequence
  Description of Artificial Sequence: Synthetic peptide
DREGYYYYGMDV

SEQ ID NO: 3982 - protein, 11 aa, Artificial Sequence
  Description of Artificial Sequence: Synthetic peptide
QASQDISNYLN

SEQ ID NO: 3983 - protein, 7 aa, Artificial Sequence
  Description of Artificial Sequence: Synthetic peptide
AASNLET

SEQ ID NO: 3984 - protein, 9 aa, Artificial Sequence
  Description of Artificial Sequence: Synthetic peptide
QQYDSLPIT

SEQ ID NO: 3985 - protein, 7 aa, Artificial Sequence
  Description of Artificial Sequence: Synthetic peptide
GGSISGF

SEQ ID NO: 3986 - protein, 5 aa, Artificial Sequence
  Description of Artificial Sequence: Synthetic peptide
YTSEN

SEQ ID NO: 3987 - protein, 11 aa, Artificial Sequence
  Description of Artificial Sequence: Synthetic peptide
DREGYYYYGMD

SEQ ID NO: 3988 - protein, 7 aa, Artificial Sequence
  Description of Artificial Sequence: Synthetic peptide
SQDISNY

SEQ ID NO: 3989 - protein, 3 aa, Artificial Sequence
  Description of Artificial Sequence: Synthetic peptide
AAS

SEQ ID NO: 3990 - protein, 6 aa, Artificial Sequence
  Description of Artificial Sequence: Synthetic peptide
YDSLPI

SEQ ID NO: 3991 - protein, 10 aa, Artificial Sequence
  Description of Artificial Sequence: Synthetic peptide
GGSISGFYWS

SEQ ID NO: 3992 - protein, 9 aa, Artificial Sequence
  Description of Artificial Sequence: Synthetic peptide
RIYTSENTN

SEQ ID NO: 3993 - protein, 12 aa, Artificial Sequence
  Description of Artificial Sequence: Synthetic peptide
DREGYYYYGMDV

SEQ ID NO: 3994 - protein, 11 aa, Artificial Sequence
  Description of Artificial Sequence: Synthetic peptide
QASQDISNYLN

SEQ ID NO: 3995 - protein, 7 aa, Artificial Sequence
  Description of Artificial Sequence: Synthetic peptide
AASNLET

SEQ ID NO: 3996 - protein, 9 aa, Artificial Sequence
  Description of Artificial Sequence: Synthetic peptide
QQYDSLPIT

SEQ ID NO: 3997 - protein, 6 aa, Artificial Sequence
  Description of Artificial Sequence: Synthetic peptide
SGFYWS

SEQ ID NO: 3998 - protein, 12 aa, Artificial Sequence
  Description of Artificial Sequence: Synthetic peptide
WIGRIYTSENTN

SEQ ID NO: 3999 - protein, 13 aa, Artificial Sequence
  Description of Artificial Sequence: Synthetic peptide
ARDREGYYYYGMD

SEQ ID NO: 4000 - protein, 7 aa, Artificial Sequence
  Description of Artificial Sequence: Synthetic peptide
SNYLNWY

SEQ ID NO: 4001 - protein, 10 aa, Artificial Sequence
  Description of Artificial Sequence: Synthetic peptide
LLIYAASNLE

SEQ ID NO: 4002 - protein, 8 aa, Artificial Sequence
  Description of Artificial Sequence: Synthetic peptide
QQYDSLPI

SEQ ID NO: 4003 - protein, 8 aa, Artificial Sequence
  Description of Artificial Sequence: Synthetic peptide
GGSISGFY

SEQ ID NO: 4004 - protein, 7 aa, Artificial Sequence
  Description of Artificial Sequence: Synthetic peptide
IYTSENT

SEQ ID NO: 4005 - protein, 14 aa, Artificial Sequence
  Description of Artificial Sequence: Synthetic peptide
ARDREGYYYYGMDV

SEQ ID NO: 4006 - protein, 6 aa, Artificial Sequence
  Description of Artificial Sequence: Synthetic peptide
QDISNY

SEQ ID NO: 4007 - protein, 3 aa, Artificial Sequence
  Description of Artificial Sequence: Synthetic peptide
AAS

SEQ ID NO: 4008 - protein, 9 aa, Artificial Sequence
  Description of Artificial Sequence: Synthetic peptide
QQYDSLPIT

SEQ ID NO: 4009 - protein, 120 aa, Artificial Sequence
  Description of Artificial Sequence: Synthetic polypeptide
QVQLQESGPGLVKPSETLSLTCTVSGGSISGFYWSWIRQPAGKGLEWIGRIYTSENTNYNPSLKSRVTMSVDTSKNQFSLKLSSVTAADTAVYYCARDREGYYYYGMDVWGQGTTVTVSS

SEQ ID NO: 4010 - protein, 107 aa, Artificial Sequence
  Description of Artificial Sequence: Synthetic polypeptide
DIQMTQSPSSLSASVGDRVTITCQASQDISNYLNWYQQKPGKAPKLLIYAASNLETGVPSRFSGSGSGTDFTFTISSLQPEDIATYYCQQYDSLPITFGQGTRLEIK

SEQ ID NO: 4011-4012 - skipped (2 entries)

SEQ ID NO: 4013 - protein, 5 aa, Artificial Sequence
  Description of Artificial Sequence: Synthetic peptide
TYYWS

SEQ ID NO: 4014 - protein, 16 aa, Artificial Sequence
  Description of Artificial Sequence: Synthetic peptide
RICTTENTNYNPSLKS

SEQ ID NO: 4015 - protein, 12 aa, Artificial Sequence
  Description of Artificial Sequence: Synthetic peptide
DLERLNYYGMDV

SEQ ID NO: 4016 - protein, 11 aa, Artificial Sequence
  Description of Artificial Sequence: Synthetic peptide
QASQDISKYLN

SEQ ID NO: 4017 - protein, 7 aa, Artificial Sequence
  Description of Artificial Sequence: Synthetic peptide
DASNLET

SEQ ID NO: 4018 - protein, 9 aa, Artificial Sequence
  Description of Artificial Sequence: Synthetic peptide
QQYDSLPIT

SEQ ID NO: 4019 - protein, 7 aa, Artificial Sequence
  Description of Artificial Sequence: Synthetic peptide
GGSISTY

SEQ ID NO: 4020 - protein, 5 aa, Artificial Sequence
  Description of Artificial Sequence: Synthetic peptide
CTTEN

SEQ ID NO: 4021 - protein, 11 aa, Artificial Sequence
  Description of Artificial Sequence: Synthetic peptide
DLERLNYYGMD

SEQ ID NO: 4022 - protein, 7 aa, Artificial Sequence
  Description of Artificial Sequence: Synthetic peptide
SQDISKY

SEQ ID NO: 4023 - protein, 3 aa, Artificial Sequence
  Description of Artificial Sequence: Synthetic peptide
DAS

SEQ ID NO: 4024 - protein, 6 aa, Artificial Sequence
  Description of Artificial Sequence: Synthetic peptide
YDSLPI

SEQ ID NO: 4025 - protein, 10 aa, Artificial Sequence
  Description of Artificial Sequence: Synthetic peptide
GGSISTYYWS

SEQ ID NO: 4026 - protein, 9 aa, Artificial Sequence
  Description of Artificial Sequence: Synthetic peptide
RICTTENTN

SEQ ID NO: 4027 - protein, 12 aa, Artificial Sequence
  Description of Artificial Sequence: Synthetic peptide
DLERLNYYGMDV

SEQ ID NO: 4028 - protein, 11 aa, Artificial Sequence
  Description of Artificial Sequence: Synthetic peptide
QASQDISKYLN

SEQ ID NO: 4029 - protein, 7 aa, Artificial Sequence
  Description of Artificial Sequence: Synthetic peptide
DASNLET

SEQ ID NO: 4030 - protein, 9 aa, Artificial Sequence
  Description of Artificial Sequence: Synthetic peptide
QQYDSLPIT

SEQ ID NO: 4031 - protein, 6 aa, Artificial Sequence
  Description of Artificial Sequence: Synthetic peptide
STYYWS

SEQ ID NO: 4032 - protein, 12 aa, Artificial Sequence
  Description of Artificial Sequence: Synthetic peptide
WIGRICTTENTN

SEQ ID NO: 4033 - protein, 13 aa, Artificial Sequence
  Description of Artificial Sequence: Synthetic peptide
ARDLERLNYYGMD

SEQ ID NO: 4034 - protein, 7 aa, Artificial Sequence
  Description of Artificial Sequence: Synthetic peptide
SKYLNWY

SEQ ID NO: 4035 - protein, 10 aa, Artificial Sequence
  Description of Artificial Sequence: Synthetic peptide
LLIYDASNLE

SEQ ID NO: 4036 - protein, 8 aa, Artificial Sequence
  Description of Artificial Sequence: Synthetic peptide
QQYDSLPI

SEQ ID NO: 4037 - protein, 8 aa, Artificial Sequence
  Description of Artificial Sequence: Synthetic peptide
GGSISTYY

SEQ ID NO: 4038 - protein, 7 aa, Artificial Sequence
  Description of Artificial Sequence: Synthetic peptide
ICTTENT

SEQ ID NO: 4039 - protein, 14 aa, Artificial Sequence
  Description of Artificial Sequence: Synthetic peptide
ARDLERLNYYGMDV

SEQ ID NO: 4040 - protein, 6 aa, Artificial Sequence
  Description of Artificial Sequence: Synthetic peptide
QDISKY

SEQ ID NO: 4041 - protein, 3 aa, Artificial Sequence
  Description of Artificial Sequence: Synthetic peptide
DAS

SEQ ID NO: 4042 - protein, 9 aa, Artificial Sequence
  Description of Artificial Sequence: Synthetic peptide
QQYDSLPIT

SEQ ID NO: 4043 - protein, 120 aa, Artificial Sequence
  Description of Artificial Sequence: Synthetic polypeptide
QVQLQESGPGLVKPSETLSLTCSVSGGSISTYYWSWIRQPAGKGLEWIGRICTTENTNYNPSLKSRVTMSIDSSKNQFSLKLSSVTAADTAVYYCARDLERLNYYGMDVWGQGATVTVSS

SEQ ID NO: 4044 - protein, 107 aa, Artificial Sequence
  Description of Artificial Sequence: Synthetic polypeptide
DIQMTQSPSSLSASVGDRVTITCQASQDISKYLNWYQQKPGIAPKLLIYDASNLETGVPSRFSGSGSGTDFTFTISSLQPEDFATYYCQQYDSLPITFGQGTRLEIK

SEQ ID NO: 4045-4046 - skipped (2 entries)

SEQ ID NO: 4047 - protein, 5 aa, Artificial Sequence
  Description of Artificial Sequence: Synthetic peptide
TYYWS

SEQ ID NO: 4048 - protein, 16 aa, Artificial Sequence
  Description of Artificial Sequence: Synthetic peptide
RICTTENTNYNPSLKS

SEQ ID NO: 4049 - protein, 12 aa, Artificial Sequence
  Description of Artificial Sequence: Synthetic peptide
DLERLNYYGMDV

SEQ ID NO: 4050 - protein, 11 aa, Artificial Sequence
  Description of Artificial Sequence: Synthetic peptide
QASQDISNYLN

SEQ ID NO: 4051 - protein, 7 aa, Artificial Sequence
  Description of Artificial Sequence: Synthetic peptide
DASNLET

SEQ ID NO: 4052 - protein, 9 aa, Artificial Sequence
  Description of Artificial Sequence: Synthetic peptide
QQYDSLPIT

SEQ ID NO: 4053 - protein, 7 aa, Artificial Sequence
  Description of Artificial Sequence: Synthetic peptide
GGSISTY

SEQ ID NO: 4054 - protein, 5 aa, Artificial Sequence
  Description of Artificial Sequence: Synthetic peptide
CTTEN

SEQ ID NO: 4055 - protein, 11 aa, Artificial Sequence
  Description of Artificial Sequence: Synthetic peptide
DLERLNYYGMD

SEQ ID NO: 4056 - protein, 7 aa, Artificial Sequence
  Description of Artificial Sequence: Synthetic peptide
SQDISNY

SEQ ID NO: 4057 - protein, 3 aa, Artificial Sequence
  Description of Artificial Sequence: Synthetic peptide
DAS

SEQ ID NO: 4058 - protein, 6 aa, Artificial Sequence
  Description of Artificial Sequence: Synthetic peptide
YDSLPI

SEQ ID NO: 4059 - protein, 10 aa, Artificial Sequence
  Description of Artificial Sequence: Synthetic peptide
GGSISTYYWS

SEQ ID NO: 4060 - protein, 9 aa, Artificial Sequence
  Description of Artificial Sequence: Synthetic peptide
RICTTENTN

SEQ ID NO: 4061 - protein, 12 aa, Artificial Sequence
  Description of Artificial Sequence: Synthetic peptide
DLERLNYYGMDV

SEQ ID NO: 4062 - protein, 11 aa, Artificial Sequence
  Description of Artificial Sequence: Synthetic peptide
QASQDISNYLN

SEQ ID NO: 4063 - protein, 7 aa, Artificial Sequence
  Description of Artificial Sequence: Synthetic peptide
DASNLET

SEQ ID NO: 4064 - protein, 9 aa, Artificial Sequence
  Description of Artificial Sequence: Synthetic peptide
QQYDSLPIT

SEQ ID NO: 4065 - protein, 6 aa, Artificial Sequence
  Description of Artificial Sequence: Synthetic peptide
STYYWS

SEQ ID NO: 4066 - protein, 12 aa, Artificial Sequence
  Description of Artificial Sequence: Synthetic peptide
WIGRICTTENTN

SEQ ID NO: 4067 - protein, 13 aa, Artificial Sequence
  Description of Artificial Sequence: Synthetic peptide
ARDLERLNYYGMD

SEQ ID NO: 4068 - protein, 7 aa, Artificial Sequence
  Description of Artificial Sequence: Synthetic peptide
SNYLNWY

SEQ ID NO: 4069 - protein, 10 aa, Artificial Sequence
  Description of Artificial Sequence: Synthetic peptide
LLIYDASNLE

SEQ ID NO: 4070 - protein, 8 aa, Artificial Sequence
  Description of Artificial Sequence: Synthetic peptide
QQYDSLPI

SEQ ID NO: 4071 - protein, 8 aa, Artificial Sequence
  Description of Artificial Sequence: Synthetic peptide
GGSISTYY

SEQ ID NO: 4072 - protein, 7 aa, Artificial Sequence
  Description of Artificial Sequence: Synthetic peptide
ICTTENT

SEQ ID NO: 4073 - protein, 14 aa, Artificial Sequence
  Description of Artificial Sequence: Synthetic peptide
ARDLERLNYYGMDV

SEQ ID NO: 4074 - protein, 6 aa, Artificial Sequence
  Description of Artificial Sequence: Synthetic peptide
QDISNY

SEQ ID NO: 4075 - protein, 3 aa, Artificial Sequence
  Description of Artificial Sequence: Synthetic peptide
DAS

SEQ ID NO: 4076 - protein, 9 aa, Artificial Sequence
  Description of Artificial Sequence: Synthetic peptide
QQYDSLPIT

SEQ ID NO: 4077 - protein, 120 aa, Artificial Sequence; identical to SEQ ID NO: 4043
  Description of Artificial Sequence: Synthetic polypeptide

SEQ ID NO: 4078 - protein, 107 aa, Artificial Sequence
  Description of Artificial Sequence: Synthetic polypeptide
DIQMTQSPSSLSASVGDRVTITCQASQDISNYLNWYQQKPGIAPKLLIYDASNLETGVPSRFSGSGSGTDFTFTISSLQPEDIATYYCQQYDSLPITFGQGTRLEIK

SEQ ID NO: 4079-4080 - skipped (2 entries)

SEQ ID NO: 4081 - protein, 5 aa, Artificial Sequence
  Description of Artificial Sequence: Synthetic peptide
NYDMH

SEQ ID NO: 4082 - protein, 16 aa, Artificial Sequence
  Description of Artificial Sequence: Synthetic peptide
TIGTAGDTYYPGSVKG

SEQ ID NO: 4083 - protein, 10 aa, Artificial Sequence
  Description of Artificial Sequence: Synthetic peptide
GGYDYYGMDV

SEQ ID NO: 4084 - protein, 12 aa, Artificial Sequence
  Description of Artificial Sequence: Synthetic peptide
RASQSITSIYLA

SEQ ID NO: 4085 - protein, 7 aa, Artificial Sequence
  Description of Artificial Sequence: Synthetic peptide
GASSRAT

SEQ ID NO: 4086 - protein, 9 aa, Artificial Sequence
  Description of Artificial Sequence: Synthetic peptide
QQYGSSPFT

SEQ ID NO: 4087 - protein, 7 aa, Artificial Sequence
  Description of Artificial Sequence: Synthetic peptide
GFTFSNY

SEQ ID NO: 4088 - protein, 5 aa, Artificial Sequence
  Description of Artificial Sequence: Synthetic peptide
GTAGD

SEQ ID NO: 4089 - protein, 9 aa, Artificial Sequence
  Description of Artificial Sequence: Synthetic peptide
GGYDYYGMD

SEQ ID NO: 4090 - protein, 8 aa, Artificial Sequence
  Description of Artificial Sequence: Synthetic peptide
SQSITSIY

SEQ ID NO: 4091 - protein, 3 aa, Artificial Sequence
  Description of Artificial Sequence: Synthetic peptide
GAS

SEQ ID NO: 4092 - protein, 6 aa, Artificial Sequence
  Description of Artificial Sequence: Synthetic peptide
YGSSPF

SEQ ID NO: 4093 - protein, 10 aa, Artificial Sequence
  Description of Artificial Sequence: Synthetic peptide
GFTFSNYDMH

SEQ ID NO: 4094 - protein, 9 aa, Artificial Sequence
  Description of Artificial Sequence: Synthetic peptide
TIGTAGDTY

SEQ ID NO: 4095 - protein, 10 aa, Artificial Sequence
  Description of Artificial Sequence: Synthetic peptide
GGYDYYGMDV

SEQ ID NO: 4096 - protein, 12 aa, Artificial Sequence
  Description of Artificial Sequence: Synthetic peptide
RASQSITSIYLA

SEQ ID NO: 4097 - protein, 7 aa, Artificial Sequence
  Description of Artificial Sequence: Synthetic peptide
GASSRAT

SEQ ID NO: 4098 - protein, 9 aa, Artificial Sequence
  Description of Artificial Sequence: Synthetic peptide
QQYGSSPFT

SEQ ID NO: 4099 - protein, 6 aa, Artificial Sequence
  Description of Artificial Sequence: Synthetic peptide
SNYDMH

SEQ ID NO: 4100 - protein, 12 aa, Artificial Sequence
  Description of Artificial Sequence: Synthetic peptide
WVSTIGTAGDTY

SEQ ID NO: 4101 - protein, 11 aa, Artificial Sequence
  Description of Artificial Sequence: Synthetic peptide
ARGGYDYYGMD

SEQ ID NO: 4102 - protein, 8 aa, Artificial Sequence
  Description of Artificial Sequence: Synthetic peptide
TSIYLAWY

SEQ ID NO: 4103 - protein, 10 aa, Artificial Sequence
  Description of Artificial Sequence: Synthetic peptide
LLIYGASSRA

SEQ ID NO: 4104 - protein, 8 aa, Artificial Sequence
  Description of Artificial Sequence: Synthetic peptide
QQYGSSPF

SEQ ID NO: 4105 - protein, 8 aa, Artificial Sequence
  Description of Artificial Sequence: Synthetic peptide
GFTFSNYD

SEQ ID NO: 4106 - protein, 7 aa, Artificial Sequence
  Description of Artificial Sequence: Synthetic peptide
IGTAGDT

SEQ ID NO: 4107 - protein, 12 aa, Artificial Sequence
  Description of Artificial Sequence: Synthetic peptide
ARGGYDYYGMDV

SEQ ID NO: 4108 - protein, 7 aa, Artificial Sequence
  Description of Artificial Sequence: Synthetic peptide
QSITSIY

SEQ ID NO: 4109 - protein, 3 aa, Artificial Sequence
  Description of Artificial Sequence: Synthetic peptide
GAS

SEQ ID NO: 4110 - protein, 9 aa, Artificial Sequence
  Description of Artificial Sequence: Synthetic peptide
QQYGSSPFT

SEQ ID NO: 4111 - protein, 118 aa, Artificial Sequence
  Description of Artificial Sequence: Synthetic polypeptide
EVQLVESGGGLVQPGGSLRLSCAASGFTFSNYDMHWVRQATGKGLEWVSTIGTAGDTYYPGSVKGRFTISRENAKNSLYLQMNSLRAGDTAVYYCARGGYDYYGMDVWGQGTTVTVSS

SEQ ID NO: 4112 - protein, 108 aa, Artificial Sequence
  Description of Artificial Sequence: Synthetic polypeptide
EIVLTQSPGTLSLSPGERATLSCRASQSITSIYLAWYRQKPGQAPRLLIYGASSRATGIPDRFSGSGSGTDFTLTISRLEPEDFAVYYCQQYGSSPFTFGPGTKVDIK

SEQ ID NO: 4113-4114 - skipped (2 entries)

SEQ ID NO: 4115 - protein, 5 aa, Artificial Sequence
  Description of Artificial Sequence: Synthetic peptide
SYDMH

SEQ ID NO: 4116 - protein, 16 aa, Artificial Sequence
  Description of Artificial Sequence: Synthetic peptide
TIGTAGDTYYPGSVKG

SEQ ID NO: 4117 - protein, 10 aa, Artificial Sequence
  Description of Artificial Sequence: Synthetic peptide
GGYSYYGMDV

SEQ ID NO: 4118 - protein, 12 aa, Artificial Sequence
  Description of Artificial Sequence: Synthetic peptide
GASQSVSSTYLA

SEQ ID NO: 4119 - protein, 7 aa, Artificial Sequence
  Description of Artificial Sequence: Synthetic peptide
GASSRAT

SEQ ID NO: 4120 - protein, 9 aa, Artificial Sequence
  Description of Artificial Sequence: Synthetic peptide
QQFGSSPFT

SEQ ID NO: 4121 - protein, 7 aa, Artificial Sequence
  Description of Artificial Sequence: Synthetic peptide
GFTFSSY

SEQ ID NO: 4122 - protein, 5 aa, Artificial Sequence
  Description of Artificial Sequence: Synthetic peptide
GTAGD

SEQ ID NO: 4123 - protein, 9 aa, Artificial Sequence
  Description of Artificial Sequence: Synthetic peptide
GGYSYYGMD

SEQ ID NO: 4124 - protein, 8 aa, Artificial Sequence
  Description of Artificial Sequence: Synthetic peptide
SQSVSSTY

SEQ ID NO: 4125 - protein, 3 aa, Artificial Sequence
  Description of Artificial Sequence: Synthetic peptide
GAS

SEQ ID NO: 4126 - protein, 6 aa, Artificial Sequence
  Description of Artificial Sequence: Synthetic peptide
FGSSPF

SEQ ID NO: 4127 - protein, 10 aa, Artificial Sequence
  Description of Artificial Sequence: Synthetic peptide
GFTFSSYDMH

SEQ ID NO: 4128 - protein, 9 aa, Artificial Sequence
  Description of Artificial Sequence: Synthetic peptide
TIGTAGDTY

SEQ ID NO: 4129 - protein, 10 aa, Artificial Sequence
  Description of Artificial Sequence: Synthetic peptide
GGYSYYGMDV

SEQ ID NO: 4130 - protein, 12 aa, Artificial Sequence
  Description of Artificial Sequence: Synthetic peptide
GASQSVSSTYLA

SEQ ID NO: 4131 - protein, 7 aa, Artificial Sequence
  Description of Artificial Sequence: Synthetic peptide
GASSRAT

SEQ ID NO: 4132 - protein, 9 aa, Artificial Sequence
  Description of Artificial Sequence: Synthetic peptide
QQFGSSPFT

SEQ ID NO: 4133 - protein, 6 aa, Artificial Sequence
  Description of Artificial Sequence: Synthetic peptide
SSYDMH

SEQ ID NO: 4134 - protein, 12 aa, Artificial Sequence
  Description of Artificial Sequence: Synthetic peptide
WVSTIGTAGDTY

SEQ ID NO: 4135 - protein, 11 aa, Artificial Sequence
  Description of Artificial Sequence: Synthetic peptide
ARGGYSYYGMD

SEQ ID NO: 4136 - protein, 8 aa, Artificial Sequence
  Description of Artificial Sequence: Synthetic peptide
SSTYLAWY

SEQ ID NO: 4137 - protein, 10 aa, Artificial Sequence
  Description of Artificial Sequence: Synthetic peptide
LLIYGASSRA

SEQ ID NO: 4138 - protein, 8 aa, Artificial Sequence
  Description of Artificial Sequence: Synthetic peptide
QQFGSSPF

SEQ ID NO: 4139 - protein, 8 aa, Artificial Sequence
  Description of Artificial Sequence: Synthetic peptide
GFTFSSYD

SEQ ID NO: 4140 - protein, 7 aa, Artificial Sequence
  Description of Artificial Sequence: Synthetic peptide
IGTAGDT

SEQ ID NO: 4141 - protein, 12 aa, Artificial Sequence
  Description of Artificial Sequence: Synthetic peptide
ARGGYSYYGMDV

SEQ ID NO: 4142 - protein, 7 aa, Artificial Sequence
  Description of Artificial Sequence: Synthetic peptide
QSVSSTY

SEQ ID NO: 4143 - protein, 3 aa, Artificial Sequence
  Description of Artificial Sequence: Synthetic peptide
GAS

SEQ ID NO: 4144 - protein, 9 aa, Artificial Sequence
  Description of Artificial Sequence: Synthetic peptide
QQFGSSPFT

SEQ ID NO: 4145 - protein, 118 aa, Artificial Sequence
  Description of Artificial Sequence: Synthetic polypeptide
EVQLVESGGGLVQPGGSLRLSCAASGFTFSSYDMHWVRQATGKGLEWVSTIGTAGDTYYPGSVKGRFTISRENAKNSLYLQMNSLRAGDTAVYYCARGGYSYYGMDVWGQGTTVTVSS

SEQ ID NO: 4146 - protein, 108 aa, Artificial Sequence
  Description of Artificial Sequence: Synthetic polypeptide
EIVLTQSPGTLSLSPGERATLSCGASQSVSSTYLAWYQQKPGQAPRLLIYGASSRATGIPDRFSGSGSGTDFTLTISRLEPEDFAVYYCQQFGSSPFTFGPGTKVDIK

SEQ ID NO: 4147-4148 - skipped (2 entries)

SEQ ID NO: 4149 - protein, 5 aa, Artificial Sequence
  Description of Artificial Sequence: Synthetic peptide
SYDMH

SEQ ID NO: 4150 - protein, 16 aa, Artificial Sequence
  Description of Artificial Sequence: Synthetic peptide
TIGTAGDTYYPGSVKG

SEQ ID NO: 4151 - protein, 10 aa, Artificial Sequence
  Description of Artificial Sequence: Synthetic peptide
GDYYYYGMDV

SEQ ID NO: 4152 - protein, 12 aa, Artificial Sequence
  Description of Artificial Sequence: Synthetic peptide
RASQSVSSTYLA

SEQ ID NO: 4153 - protein, 7 aa, Artificial Sequence
  Description of Artificial Sequence: Synthetic peptide
GASNRAT

SEQ ID NO: 4154 - protein, 9 aa, Artificial Sequence
  Description of Artificial Sequence: Synthetic peptide
QQFGTSPFT

SEQ ID NO: 4155 - protein, 7 aa, Artificial Sequence
  Description of Artificial Sequence: Synthetic peptide
GFTFSSY

SEQ ID NO: 4156 - protein, 5 aa, Artificial Sequence
  Description of Artificial Sequence: Synthetic peptide
GTAGD

SEQ ID NO: 4157 - protein, 9 aa, Artificial Sequence
  Description of Artificial Sequence: Synthetic peptide
GDYYYYGMD

SEQ ID NO: 4158 - protein, 8 aa, Artificial Sequence
  Description of Artificial Sequence: Synthetic peptide
SQSVSSTY

SEQ ID NO: 4159 - protein, 3 aa, Artificial Sequence
  Description of Artificial Sequence: Synthetic peptide
GAS

SEQ ID NO: 4160 - protein, 6 aa, Artificial Sequence
  Description of Artificial Sequence: Synthetic peptide
FGTSPF

SEQ ID NO: 4161 - protein, 10 aa, Artificial Sequence
  Description of Artificial Sequence: Synthetic peptide
GFTFSSYDMH

SEQ ID NO: 4162 - protein, 9 aa, Artificial Sequence
  Description of Artificial Sequence: Synthetic peptide
TIGTAGDTY

SEQ ID NO: 4163 - protein, 10 aa, Artificial Sequence
  Description of Artificial Sequence: Synthetic peptide
GDYYYYGMDV

SEQ ID NO: 4164 - protein, 12 aa, Artificial Sequence
  Description of Artificial Sequence: Synthetic peptide
RASQSVSSTYLA

SEQ ID NO: 4165 - protein, 7 aa, Artificial Sequence
  Description of Artificial Sequence: Synthetic peptide
GASNRAT

SEQ ID NO: 4166 - protein, 9 aa, Artificial Sequence
  Description of Artificial Sequence: Synthetic peptide
QQFGTSPFT

SEQ ID NO: 4167 - protein, 6 aa, Artificial Sequence
  Description of Artificial Sequence: Synthetic peptide
SSYDMH

SEQ ID NO: 4168 - protein, 12 aa, Artificial Sequence
  Description of Artificial Sequence: Synthetic peptide
WVSTIGTAGDTY

SEQ ID NO: 4169 - protein, 11 aa, Artificial Sequence
  Description of Artificial Sequence: Synthetic peptide
ARGDYYYYGMD

SEQ ID NO: 4170 - protein, 8 aa, Artificial Sequence
  Description of Artificial Sequence: Synthetic peptide
SSTYLAWY

SEQ ID NO: 4171 - protein, 10 aa, Artificial Sequence
  Description of Artificial Sequence: Synthetic peptide
LLIYGASNRA

SEQ ID NO: 4172 - protein, 8 aa, Artificial Sequence
  Description of Artificial Sequence: Synthetic peptide
QQFGTSPF

SEQ ID NO: 4173 - protein, 8 aa, Artificial Sequence
  Description of Artificial Sequence: Synthetic peptide
GFTFSSYD

SEQ ID NO: 4174 - protein, 7 aa, Artificial Sequence
  Description of Artificial Sequence: Synthetic peptide
IGTAGDT

SEQ ID NO: 4175 - protein, 12 aa, Artificial Sequence
  Description of Artificial Sequence: Synthetic peptide
ARGDYYYYGMDV

SEQ ID NO: 4176 - protein, 7 aa, Artificial Sequence
  Description of Artificial Sequence: Synthetic peptide
QSVSSTY

SEQ ID NO: 4177 - protein, 3 aa, Artificial Sequence
  Description of Artificial Sequence: Synthetic peptide
GAS

SEQ ID NO: 4178 - protein, 9 aa, Artificial Sequence
  Description of Artificial Sequence: Synthetic peptide
QQFGTSPFT

SEQ ID NO: 4179 - protein, 118 aa, Artificial Sequence
  Description of Artificial Sequence: Synthetic polypeptide
EVQLVESGGGLVQPGGSLRLSCAASGFTFSSYDMHWVRQATGKGLEWVSTIGTAGDTYYPGSVKGRFTISRENAENSLYLQMNSLRAGDTALYYCARGDYYYYGMDVWGQGTTVTVSS

SEQ ID NO: 4180 - protein, 108 aa, Artificial Sequence
  Description of Artificial Sequence: Synthetic polypeptide
EIVLTQSPGTLSLSPGERATLSCRASQSVSSTYLAWYQQKPGQAPRLLIYGASNRATGIPDRFSGSGSGTDFTLTISRLEPEDFAVYYCQQFGTSPFTFGPGTKVDIK

SEQ ID NO: 4181 - protein, 448 aa, Artificial Sequence
  Description of Artificial Sequence: Synthetic peptide
EVQLVESGGGLVQPGGSLRLSCAASGFTFSSYDMHWVRQATGKGLEWVSTIGTAGDTYYPGSVKGRFTISRENAENSLYLQMNSLRAGDTALYYCARGDYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4182 - protein, 215 aa, Artificial Sequence
  Description of Artificial Sequence: Synthetic peptide
EIVLTQSPGTLSLSPGERATLSCRASQSVSSTYLAWYQQKPGQAPRLLIYGASNRATGIPDRFSGSGSGTDFTLTISRLEPEDFAVYYCQQFGTSPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4183 - protein, 5 aa, Artificial Sequence
  Description of Artificial Sequence: Synthetic peptide
SYYWS

SEQ ID NO: 4184 - protein, 16 aa, Artificial Sequence
  Description of Artificial Sequence: Synthetic peptide
RIYASGSTNYNPSLKS

SEQ ID NO: 4185 - protein, 12 aa, Artificial Sequence
  Description of Artificial Sequence: Synthetic peptide
DREGYYYYGMDV

SEQ ID NO: 4186 - protein, 11 aa, Artificial Sequence
  Description of Artificial Sequence: Synthetic peptide
QASQDISKYLN

SEQ ID NO: 4187 - protein, 7 aa, Artificial Sequence
  Description of Artificial Sequence: Synthetic peptide
AASNLET

SEQ ID NO: 4188 - protein, 9 aa, Artificial Sequence
  Description of Artificial Sequence: Synthetic peptide
QQYDSLPIT

SEQ ID NO: 4189 - protein, 7 aa, Artificial Sequence
  Description of Artificial Sequence: Synthetic peptide
GGSISSY

SEQ ID NO: 4190 - protein, 5 aa, Artificial Sequence
  Description of Artificial Sequence: Synthetic peptide
YASGS

SEQ ID NO: 4191 - protein, 11 aa, Artificial Sequence
  Description of Artificial Sequence: Synthetic peptide
DREGYYYYGMD

SEQ ID NO: 4192 - protein, 7 aa, Artificial Sequence
  Description of Artificial Sequence: Synthetic peptide
SQDISKY

SEQ ID NO: 4193 - protein, 3 aa, Artificial Sequence
  Description of Artificial Sequence: Synthetic peptide
AAS

SEQ ID NO: 4194 - protein, 6 aa, Artificial Sequence
  Description of Artificial Sequence: Synthetic peptide
YDSLPI

SEQ ID NO: 4195 - protein, 10 aa, Artificial Sequence
  Description of Artificial Sequence: Synthetic peptide
GGSISSYYWS

SEQ ID NO: 4196 - protein, 9 aa, Artificial Sequence
  Description of Artificial Sequence: Synthetic peptide
RIYASGSTN

SEQ ID NO: 4197 - protein, 12 aa, Artificial Sequence
  Description of Artificial Sequence: Synthetic peptide
DREGYYYYGMDV

SEQ ID NO: 4198 - protein, 11 aa, Artificial Sequence
  Description of Artificial Sequence: Synthetic peptide
QASQDISKYLN

SEQ ID NO: 4199 - protein, 7 aa, Artificial Sequence
  Description of Artificial Sequence: Synthetic peptide
AASNLET

SEQ ID NO: 4200 - protein, 9 aa, Artificial Sequence
  Description of Artificial Sequence: Synthetic peptide
QQYDSLPIT

SEQ ID NO: 4201 - protein, 6 aa, Artificial Sequence
  Description of Artificial Sequence: Synthetic peptide
SSYYWS

SEQ ID NO: 4202 - protein, 12 aa, Artificial Sequence
  Description of Artificial Sequence: Synthetic peptide
WIGRIYASGSTN

SEQ ID NO: 4203 - protein, 13 aa, Artificial Sequence
  Description of Artificial Sequence: Synthetic peptide
ARDREGYYYYGMD

SEQ ID NO: 4204 - protein, 7 aa, Artificial Sequence
  Description of Artificial Sequence: Synthetic peptide
SKYLNWY

SEQ ID NO: 4205 - protein, 10 aa, Artificial Sequence
  Description of Artificial Sequence: Synthetic peptide
LLIYAASNLE

SEQ ID NO: 4206 - protein, 8 aa, Artificial Sequence
  Description of Artificial Sequence: Synthetic peptide
QQYDSLPI

SEQ ID NO: 4207 - protein, 8 aa, Artificial Sequence
  Description of Artificial Sequence: Synthetic peptide
GGSISSYY

SEQ ID NO: 4208 - protein, 7 aa, Artificial Sequence
  Description of Artificial Sequence: Synthetic peptide
IYASGST

SEQ ID NO: 4209 - protein, 14 aa, Artificial Sequence
  Description of Artificial Sequence: Synthetic peptide
ARDREGYYYYGMDV

SEQ ID NO: 4210 - protein, 6 aa, Artificial Sequence
  Description of Artificial Sequence: Synthetic peptide
QDISKY

SEQ ID NO: 4211 - protein, 3 aa, Artificial Sequence
  Description of Artificial Sequence: Synthetic peptide
AAS

SEQ ID NO: 4212 - protein, 9 aa, Artificial Sequence
  Description of Artificial Sequence: Synthetic peptide
QQYDSLPIT

SEQ ID NO: 4213 - protein, 120 aa, Artificial Sequence
  Description of Artificial Sequence: Synthetic polypeptide
QVQLQESDPGLVKPSETLSLTCTVSGGSISSYYWSWIRQPAGKGLEWIGRIYASGSTNYNPSLKSRVTMSVDTSKNQFSLKLSSVTAADTAVYYCARDREGYYYYGMDVWGQGTTVTVSS

SEQ ID NO: 4214 - protein, 107 aa, Artificial Sequence
  Description of Artificial Sequence: Synthetic polypeptide
DIQMTQSPSSLSASVGDRVTITCQASQDISKYLNWYQQKPGKAPNLLIYAASNLETGVPSRFSGSGSGTDFTFTISSLQPEDIAAYYCQQYDSLPITFGQGTRLEIK

SEQ ID NO: 4215 - protein, 450 aa, Artificial Sequence
  Description of Artificial Sequence: Synthetic peptide
QVQLQESDPGLVKPSETLSLTCTVSGGSISSYYWSWIRQPAGKGLEWIGRIYASGSTNYNPSLKSRVTMSVDTSKNQFSLKLSSVTAADTAVYYCARDREGYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4216 - protein, 214 aa, Artificial Sequence
  Description of Artificial Sequence: Synthetic peptide
DIQMTQSPSSLSASVGDRVTITCQASQDISKYLNWYQQKPGKAPNLLIYAASNLETGVPSRFSGSGSGTDFTFTISSLQPEDIAAYYCQQYDSLPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4217 - protein, 5 aa, Artificial Sequence
  Description of Artificial Sequence: Synthetic peptide
DYWMS

SEQ ID NO: 4218 - protein, 17 aa, Artificial Sequence
  Description of Artificial Sequence: Synthetic peptide
NINQDGSEKYSVDSVKG

SEQ ID NO: 4219 - protein, 10 aa, Artificial Sequence
  Description of Artificial Sequence: Synthetic peptide
EGGQWLALDY

SEQ ID NO: 4220 - protein, 11 aa, Artificial Sequence
  Description of Artificial Sequence: Synthetic peptide
RASQGISSWLA

SEQ ID NO: 4221 - protein, 7 aa, Artificial Sequence
  Description of Artificial Sequence: Synthetic peptide
GASSLQS

SEQ ID NO: 4222 - protein, 9 aa, Artificial Sequence
  Description of Artificial Sequence: Synthetic peptide
QQANIFPWT

SEQ ID NO: 4223 - protein, 7 aa, Artificial Sequence
  Description of Artificial Sequence: Synthetic peptide
GFTFSDY

SEQ ID NO: 4224 - protein, 5 aa, Artificial Sequence
  Description of Artificial Sequence: Synthetic peptide
NQDGS

SEQ ID NO: 4225 - protein, 9 aa, Artificial Sequence
  Description of Artificial Sequence: Synthetic peptide
EGGQWLALD

SEQ ID NO: 4226 - protein, 7 aa, Artificial Sequence
  Description of Artificial Sequence: Synthetic peptide
SQGISSW

SEQ ID NO: 4227 - protein, 3 aa, Artificial Sequence
  Description of Artificial Sequence: Synthetic peptide
GAS

SEQ ID NO: 4228 - protein, 6 aa, Artificial Sequence
  Description of Artificial Sequence: Synthetic peptide
ANIFPW

SEQ ID NO: 4229 - protein, 10 aa, Artificial Sequence
  Description of Artificial Sequence: Synthetic peptide
GFTFSDYWMS

SEQ ID NO: 4230 - protein, 9 aa, Artificial Sequence
  Description of Artificial Sequence: Synthetic peptide
NINQDGSEK

SEQ ID NO: 4231 - protein, 10 aa, Artificial Sequence
  Description of Artificial Sequence: Synthetic peptide
EGGQWLALDY

SEQ ID NO: 4232 - protein, 11 aa, Artificial Sequence
  Description of Artificial Sequence: Synthetic peptide
RASQGISSWLA

SEQ ID NO: 4233 - protein, 7 aa, Artificial Sequence
  Description of Artificial Sequence: Synthetic peptide
GASSLQS

SEQ ID NO: 4234 - protein, 9 aa, Artificial Sequence
  Description of Artificial Sequence: Synthetic peptide
QQANIFPWT

SEQ ID NO: 4235 - protein, 6 aa, Artificial Sequence
  Description of Artificial Sequence: Synthetic peptide
SDYWMS

SEQ ID NO: 4236 - protein, 12 aa, Artificial Sequence
  Description of Artificial Sequence: Synthetic peptide
WVANINQDGSEK

SEQ ID NO: 4237 - protein, 11 aa, Artificial Sequence
  Description of Artificial Sequence: Synthetic peptide
AREGGQWLALD

SEQ ID NO: 4238 - protein, 7 aa, Artificial Sequence
  Description of Artificial Sequence: Synthetic peptide
SSWLAWY

SEQ ID NO: 4239 - protein, 10 aa, Artificial Sequence
  Description of Artificial Sequence: Synthetic peptide
LLIYGASSLQ

SEQ ID NO: 4240 - protein, 8 aa, Artificial Sequence
  Description of Artificial Sequence: Synthetic peptide
QQANIFPW

SEQ ID NO: 4241 - protein, 8 aa, Artificial Sequence
  Description of Artificial Sequence: Synthetic peptide
GFTFSDYW

SEQ ID NO: 4242 - protein, 7 aa, Artificial Sequence
  Description of Artificial Sequence: Synthetic peptide
INQDGSE

SEQ ID NO: 4243 - protein, 12 aa, Artificial Sequence
  Description of Artificial Sequence: Synthetic peptide
AREGGQWLALDY

SEQ ID NO: 4244 - protein, 6 aa, Artificial Sequence
  Description of Artificial Sequence: Synthetic peptide
QGISSW

SEQ ID NO: 4245 - protein, 3 aa, Artificial Sequence
  Description of Artificial Sequence: Synthetic peptide
GAS

SEQ ID NO: 4246 - protein, 9 aa, Artificial Sequence
  Description of Artificial Sequence: Synthetic peptide
QQANIFPWT

SEQ ID NO: 4247 - protein, 119 aa, Artificial Sequence
  Description of Artificial Sequence: Synthetic polypeptide
EVQLVESGGGLVQPGGSLRLSCAASGFTFSDYWMSWVRQAPGKGLEWVANINQDGSEKYSVDSVKGRFTISRDNAKNSLYLQMNSLRAEDTAIFYCAREGGQWLALDYWGQGTLVTVSS

SEQ ID NO: 4248 - protein, 107 aa, Artificial Sequence
  Description of Artificial Sequence: Synthetic polypeptide
DIQMTQSPSSVSASVGDRVTITCRASQGISSWLAWYQQKPGKAPKLLIYGASSLQSGVPSRFSGSGSGTDFTLTINSLQPEDFTTYYCQQANIFPWTFGQGTKVEIK

SEQ ID NO: 4249-4250 - skipped (2 entries)

SEQ ID NO: 4251 - protein, 5 aa, Artificial Sequence
  Description of Artificial Sequence: Synthetic peptide
SYWMS

SEQ ID NO: 4252 - protein, 17 aa, Artificial Sequence
  Description of Artificial Sequence: Synthetic peptide
NINEDGSEKYYVDSVKG

SEQ ID NO: 4253 - protein, 10 aa, Artificial Sequence
  Description of Artificial Sequence: Synthetic peptide
EGGQWLALDY

SEQ ID NO: 4254 - protein, 11 aa, Artificial Sequence
  Description of Artificial Sequence: Synthetic peptide
RASQGISSWLA

SEQ ID NO: 4255 - protein, 7 aa, Artificial Sequence
  Description of Artificial Sequence: Synthetic peptide
AASSLQS

SEQ ID NO: 4256 - protein, 9 aa, Artificial Sequence
  Description of Artificial Sequence: Synthetic peptide
QQANSFPWT

SEQ ID NO: 4257 - protein, 7 aa, Artificial Sequence
  Description of Artificial Sequence: Synthetic peptide
GFTFSSY

SEQ ID NO: 4258 - protein, 6 aa, Artificial Sequence
  Description of Artificial Sequence: Synthetic peptide
NEDGSE

SEQ ID NO: 4259 - protein, 9 aa, Artificial Sequence
  Description of Artificial Sequence: Synthetic peptide
EGGQWLALD

SEQ ID NO: 4260 - protein, 7 aa, Artificial Sequence
  Description of Artificial Sequence: Synthetic peptide
SQGISSW

SEQ ID NO: 4261 - protein, 3 aa, Artificial Sequence
  Description of Artificial Sequence: Synthetic peptide
AAS

SEQ ID NO: 4262 - protein, 6 aa, Artificial Sequence
  Description of Artificial Sequence: Synthetic peptide
ANSFPW

SEQ ID NO: 4263 - protein, 10 aa, Artificial Sequence
  Description of Artificial Sequence: Synthetic peptide
GFTFSSYWMS

SEQ ID NO: 4264 - protein, 10 aa, Artificial Sequence
  Description of Artificial Sequence: Synthetic peptide
NINEDGSEKY

SEQ ID NO: 4265 - protein, 10 aa, Artificial Sequence
  Description of Artificial Sequence: Synthetic peptide
EGGQWLALDY

SEQ ID NO: 4266 - protein, 11 aa, Artificial Sequence
  Description of Artificial Sequence: Synthetic peptide
RASQGISSWLA

SEQ ID NO: 4267 - protein, 7 aa, Artificial Sequence
  Description of Artificial Sequence: Synthetic peptide
AASSLQS

SEQ ID NO: 4268 - protein, 9 aa, Artificial Sequence
  Description of Artificial Sequence: Synthetic peptide
QQANSFPWT

SEQ ID NO: 4269 - protein, 6 aa, Artificial Sequence
  Description of Artificial Sequence: Synthetic peptide
SSYWMS

SEQ ID NO: 4270 - protein, 13 aa, Artificial Sequence
  Description of Artificial Sequence: Synthetic peptide
WVANINEDGSEKY

SEQ ID NO: 4271 - protein, 11 aa, Artificial Sequence
  Description of Artificial Sequence: Synthetic peptide
VREGGQWLALD

SEQ ID NO: 4272 - protein, 7 aa, Artificial Sequence
  Description of Artificial Sequence: Synthetic peptide
SSWLAWY

SEQ ID NO: 4273 - protein, 10 aa, Artificial Sequence
  Description of Artificial Sequence: Synthetic peptide
LLIYAASSLQ

SEQ ID NO: 4274 - protein, 8 aa, Artificial Sequence
  Description of Artificial Sequence: Synthetic peptide
QQANSFPW

SEQ ID NO: 4275 - protein, 8 aa, Artificial Sequence
  Description of Artificial Sequence: Synthetic peptide
GFTFSSYW

SEQ ID NO: 4276 - protein, 8 aa, Artificial Sequence
  Description of Artificial Sequence: Synthetic peptide
INEDGSEK

SEQ ID NO: 4277 - protein, 12 aa, Artificial Sequence
  Description of Artificial Sequence: Synthetic peptide
VREGGQWLALDY

SEQ ID NO: 4278 - protein, 6 aa, Artificial Sequence
  Description of Artificial Sequence: Synthetic peptide
QGISSW

SEQ ID NO: 4279 - protein, 3 aa, Artificial Sequence
  Description of Artificial Sequence: Synthetic peptide
AAS

SEQ ID NO: 4280 - protein, 9 aa, Artificial Sequence
  Description of Artificial Sequence: Synthetic peptide
QQANSFPWT

SEQ ID NO: 4281 - protein, 119 aa, Artificial Sequence
  Description of Artificial Sequence: Synthetic polypeptide
EVQLVESGGGLVQPGGSLRLSCAASGFTFSSYWMSWVRQAPGKGLEWVANINEDGSEKYYVDSVKGRFTISRDNAKNSLYLQMNSLRAEDTAVYYCVREGGQWLALDYWGQGTLVTVSS

SEQ ID NO: 4282 - protein, 107 aa, Artificial Sequence
  Description of Artificial Sequence: Synthetic polypeptide
DIQMTQSPSSVSASVGDRVTITCRASQGISSWLAWYQQKPGKAPKLLIYAASSLQSGVPSSFSGSGSGTDFTLTINSLQPEDFATYYCQQANSFPWTFGQGTKVAIK

SEQ ID NO: 4283 - protein, 449 aa, Artificial Sequence
  Description of Artificial Sequence: Synthetic peptide
EVQLVESGGGLVQPGGSLRLSCAASGFTFSSYWMSWVRQAPGKGLEWVANINEDGSEKYYVDSVKGRFTISRDNAKNSLYLQMNSLRAEDTAVYYCVREGGQWLALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4284 - protein, 214 aa, Artificial Sequence
  Description of Artificial Sequence: Synthetic peptide
DIQMTQSPSSVSASVGDRVTITCRASQGISSWLAWYQQKPGKAPKLLIYAASSLQSGVPSSFSGSGSGTDFTLTINSLQPEDFATYYCQQANSFPWTFGQGTKVAIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4285 - protein, 5 aa, Artificial Sequence
  Description of Artificial Sequence: Synthetic peptide
SYWMT

SEQ ID NO: 4286 - protein, 17 aa, Artificial Sequence
  Description of Artificial Sequence: Synthetic peptide
NIKQDGSEKYYVDSVKG

SEQ ID NO: 4287 - protein, 8 aa, Artificial Sequence
  Description of Artificial Sequence: Synthetic peptide
DRYDALDI

SEQ ID NO: 4288 - protein, 11 aa, Artificial Sequence
  Description of Artificial Sequence: Synthetic peptide
RASQGIRNDLN

SEQ ID NO: 4289 - protein, 7 aa, Artificial Sequence
  Description of Artificial Sequence: Synthetic peptide
AASSLQS

SEQ ID NO: 4290 - protein, 9 aa, Artificial Sequence
  Description of Artificial Sequence: Synthetic peptide
LKDYNYPYT

SEQ ID NO: 4291 - protein, 7 aa, Artificial Sequence
  Description of Artificial Sequence: Synthetic peptide
GFTFSSY

SEQ ID NO: 4292 - protein, 6 aa, Artificial Sequence
  Description of Artificial Sequence: Synthetic peptide
KQDGSE

SEQ ID NO: 4293 - protein, 7 aa, Artificial Sequence
  Description of Artificial Sequence: Synthetic peptide
DRYDALD

SEQ ID NO: 4294 - protein, 7 aa, Artificial Sequence
  Description of Artificial Sequence: Synthetic peptide
SQGIRND

SEQ ID NO: 4295 - protein, 3 aa, Artificial Sequence
  Description of Artificial Sequence: Synthetic peptide
AAS

SEQ ID NO: 4296 - protein, 6 aa, Artificial Sequence
  Description of Artificial Sequence: Synthetic peptide
DYNYPY

SEQ ID NO: 4297 - protein, 10 aa, Artificial Sequence
  Description of Artificial Sequence: Synthetic peptide
GFTFSSYWMT

SEQ ID NO: 4298 - protein, 10 aa, Artificial Sequence
  Description of Artificial Sequence: Synthetic peptide
NIKQDGSEKY

SEQ ID NO: 4299 - protein, 8 aa, Artificial Sequence
  Description of Artificial Sequence: Synthetic peptide
DRYDALDI

SEQ ID NO: 4300 - protein, 11 aa, Artificial Sequence
  Description of Artificial Sequence: Synthetic peptide
RASQGIRNDLN

SEQ ID NO: 4301 - protein, 7 aa, Artificial Sequence
  Description of Artificial Sequence: Synthetic peptide
AASSLQS

SEQ ID NO: 4302 - protein, 9 aa, Artificial Sequence
  Description of Artificial Sequence: Synthetic peptide
LKDYNYPYT

SEQ ID NO: 4303 - protein, 6 aa, Artificial Sequence
  Description of Artificial Sequence: Synthetic peptide
SSYWMT

SEQ ID NO: 4304 - protein, 13 aa, Artificial Sequence
  Description of Artificial Sequence: Synthetic peptide
WVANIKQDGSEKY

SEQ ID NO: 4305 - protein, 9 aa, Artificial Sequence
  Description of Artificial Sequence: Synthetic peptide
VRDRYDALD

SEQ ID NO: 4306 - protein, 7 aa, Artificial Sequence
  Description of Artificial Sequence: Synthetic peptide
RNDLNWY

SEQ ID NO: 4307 - protein, 10 aa, Artificial Sequence
  Description of Artificial Sequence: Synthetic peptide
LLIYAASSLQ

SEQ ID NO: 4308 - protein, 8 aa, Artificial Sequence
  Description of Artificial Sequence: Synthetic peptide
LKDYNYPY

SEQ ID NO: 4309 - protein, 8 aa, Artificial Sequence
  Description of Artificial Sequence: Synthetic peptide
GFTFSSYW

SEQ ID NO: 4310 - protein, 8 aa, Artificial Sequence
  Description of Artificial Sequence: Synthetic peptide
IKQDGSEK

SEQ ID NO: 4311 - protein, 10 aa, Artificial Sequence
  Description of Artificial Sequence: Synthetic peptide
VRDRYDALDI

SEQ ID NO: 4312 - protein, 6 aa, Artificial Sequence
  Description of Artificial Sequence: Synthetic peptide
QGIRND

SEQ ID NO: 4313 - protein, 3 aa, Artificial Sequence
  Description of Artificial Sequence: Synthetic peptide
AAS

SEQ ID NO: 4314 - protein, 9 aa, Artificial Sequence
  Description of Artificial Sequence: Synthetic peptide
LKDYNYPYT

SEQ ID NO: 4315 - protein, 117 aa, Artificial Sequence
  Description of Artificial Sequence: Synthetic polypeptide
EVQLVESGGGLVQPGGSLRLSCAASGFTFSSYWMTWVRQAPGKGLEWVANIKQDGSEKYYVDSVKGRFTISRDNAKNSLYLQMNSLRAEDTAVYYCVRDRYDALDIWGQGTMVTVSS

SEQ ID NO: 4316 - protein, 107 aa, Artificial Sequence
  Description of Artificial Sequence: Synthetic polypeptide
AIQMTQSPSSLSASVGDRVTITCRASQGIRNDLNWYQQKPGKAPKLLIYAASSLQSGVPSRFSGSGSGTDFTLTISSLQAEDFATYYCLKDYNYPYTFGQGTKLEIK

SEQ ID NO: 4317 - protein, 447 aa, Artificial Sequence
  Description of Artificial Sequence: Synthetic peptide
EVQLVESGGGLVQPGGSLRLSCAASGFTFSSYWMTWVRQAPGKGLEWVANIKQDGSEKYYVDSVKGRFTISRDNAKNSLYLQMNSLRAEDTAVYYCVRDRYDALDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4318 - protein, 214 aa, Artificial Sequence
  Description of Artificial Sequence: Synthetic peptide
AIQMTQSPSSLSASVGDRVTITCRASQGIRNDLNWYQQKPGKAPKLLIYAASSLQSGVPSRFSGSGSGTDFTLTISSLQAEDFATYYCLKDYNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4319 - protein, 5 aa, Artificial Sequence
  Description of Artificial Sequence: Synthetic peptide
SYDMH

SEQ ID NO: 4320 - protein, 16 aa, Artificial Sequence
  Description of Artificial Sequence: Synthetic peptide
TIGTAGDTYYPGSVKG

SEQ ID NO: 4321 - protein, 10 aa, Artificial Sequence
  Description of Artificial Sequence: Synthetic peptide
GNYFYYGVDV

SEQ ID NO: 4322 - protein, 12 aa, Artificial Sequence
  Description of Artificial Sequence: Synthetic peptide
RASQSVSSSYLA

SEQ ID NO: 4323 - protein, 7 aa, Artificial Sequence
  Description of Artificial Sequence: Synthetic peptide
GASSRAT

SEQ ID NO: 4324 - protein, 9 aa, Artificial Sequence
  Description of Artificial Sequence: Synthetic peptide
QQYGISPFT

SEQ ID NO: 4325 - protein, 7 aa, Artificial Sequence
  Description of Artificial Sequence: Synthetic peptide
GFTFSSY

SEQ ID NO: 4326 - protein, 5 aa, Artificial Sequence
  Description of Artificial Sequence: Synthetic peptide
GTAGD

SEQ ID NO: 4327 - protein, 9 aa, Artificial Sequence
  Description of Artificial Sequence: Synthetic peptide
GNYFYYGVD

SEQ ID NO: 4328 - protein, 8 aa, Artificial Sequence
  Description of Artificial Sequence: Synthetic peptide
SQSVSSSY

SEQ ID NO: 4329 - protein, 3 aa, Artificial Sequence
  Description of Artificial Sequence: Synthetic peptide
GAS

SEQ ID NO: 4330 - protein, 6 aa, Artificial Sequence
  Description of Artificial Sequence: Synthetic peptide
YGISPF

SEQ ID NO: 4331 - protein, 10 aa, Artificial Sequence
  Description of Artificial Sequence: Synthetic peptide
GFTFSSYDMH

SEQ ID NO: 4332 - protein, 9 aa, Artificial Sequence
  Description of Artificial Sequence: Synthetic peptide
TIGTAGDTY

SEQ ID NO: 4333 - protein, 10 aa, Artificial Sequence
  Description of Artificial Sequence: Synthetic peptide
GNYFYYGVDV

SEQ ID NO: 4334 - protein, 12 aa, Artificial Sequence
  Description of Artificial Sequence: Synthetic peptide
RASQSVSSSYLA

SEQ ID NO: 4335 - protein, 7 aa, Artificial Sequence
  Description of Artificial Sequence: Synthetic peptide
GASSRAT

SEQ ID NO: 4336 - protein, 9 aa, Artificial Sequence
  Description of Artificial Sequence: Synthetic peptide
QQYGISPFT

SEQ ID NO: 4337 - protein, 6 aa, Artificial Sequence
  Description of Artificial Sequence: Synthetic peptide
SSYDMH

SEQ ID NO: 4338 - protein, 12 aa, Artificial Sequence
  Description of Artificial Sequence: Synthetic peptide
WVSTIGTAGDTY

SEQ ID NO: 4339 - protein, 11 aa, Artificial Sequence
  Description of Artificial Sequence: Synthetic peptide
ARGNYFYYGVD

SEQ ID NO: 4340 - protein, 8 aa, Artificial Sequence
  Description of Artificial Sequence: Synthetic peptide
SSSYLAWY

SEQ ID NO: 4341 - protein, 10 aa, Artificial Sequence
  Description of Artificial Sequence: Synthetic peptide
LLIYGASSRA

SEQ ID NO: 4342 - protein, 8 aa, Artificial Sequence
  Description of Artificial Sequence: Synthetic peptide
QQYGISPF

SEQ ID NO: 4343 - protein, 8 aa, Artificial Sequence
  Description of Artificial Sequence: Synthetic peptide
GFTFSSYD

SEQ ID NO: 4344 - protein, 7 aa, Artificial Sequence
  Description of Artificial Sequence: Synthetic peptide
IGTAGDT

SEQ ID NO: 4345 - protein, 12 aa, Artificial Sequence
  Description of Artificial Sequence: Synthetic peptide
ARGNYFYYGVDV

SEQ ID NO: 4346 - protein, 7 aa, Artificial Sequence
  Description of Artificial Sequence: Synthetic peptide
QSVSSSY

SEQ ID NO: 4347 - protein, 3 aa, Artificial Sequence
  Description of Artificial Sequence: Synthetic peptide
GAS

SEQ ID NO: 4348 - protein, 9 aa, Artificial Sequence
  Description of Artificial Sequence: Synthetic peptide
QQYGISPFT

SEQ ID NO: 4349 - protein, 118 aa, Artificial Sequence
  Description of Artificial Sequence: Synthetic polypeptide
EVQLVESGGGLVQPGGSLRLSCAASGFTFSSYDMHWVRQATGKGLEWVSTIGTAGDTYYPGSVKGRFTISRENAKNSLYLQMNGLRAGDTAVYYCARGNYFYYGVDVWGQGTTVTVSS

SEQ ID NO: 4350 - protein, 108 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGISPFTFGPGTKVDIK

SEQ ID NO: 4351-4352 - skipped (2 entries)

SEQ ID NO: 4353 - protein, 5 aa, Artificial Sequence
  Description of Artificial Sequence: Synthetic peptide
SYDMH

SEQ ID NO: 4354 - protein, 16 aa, Artificial Sequence
  Description of Artificial Sequence: Synthetic peptide
TIGTAGDTYYPGSVKG

SEQ ID NO: 4355 - protein, 10 aa, Artificial Sequence
  Description of Artificial Sequence: Synthetic peptide
GGYYYYGMDV

SEQ ID NO: 4356 - protein, 12 aa, Artificial Sequence
  Description of Artificial Sequence: Synthetic peptide
RASQSFISSYLA

SEQ ID NO: 4357 - protein, 7 aa, Artificial Sequence
  Description of Artificial Sequence: Synthetic peptide
GASSRAT

SEQ ID NO: 4358 - protein, 9 aa, Artificial Sequence
  Description of Artificial Sequence: Synthetic peptide
QQSGNSPFT

SEQ ID NO: 4359 - protein, 7 aa, Artificial Sequence
  Description of Artificial Sequence: Synthetic peptide
GFTFSSY

SEQ ID NO: 4360 - protein, 5 aa, Artificial Sequence
  Description of Artificial Sequence: Synthetic peptide
GTAGD

SEQ ID NO: 4361 - protein, 9 aa, Artificial Sequence
  Description of Artificial Sequence: Synthetic peptide
GGYYYYGMD

SEQ ID NO: 4362 - protein, 8 aa, Artificial Sequence
  Description of Artificial Sequence: Synthetic peptide
SQSFISSY

SEQ ID NO: 4363 - protein, 3 aa, Artificial Sequence
  Description of Artificial Sequence: Synthetic peptide
GAS

SEQ ID NO: 4364 - protein, 6 aa, Artificial Sequence
  Description of Artificial Sequence: Synthetic peptide
SGNSPF

SEQ ID NO: 4365 - protein, 10 aa, Artificial Sequence
  Description of Artificial Sequence: Synthetic peptide
GFTFSSYDMH

SEQ ID NO: 4366 - protein, 9 aa, Artificial Sequence
  Description of Artificial Sequence: Synthetic peptide
TIGTAGDTY

SEQ ID NO: 4367 - protein, 10 aa, Artificial Sequence
  Description of Artificial Sequence: Synthetic peptide
GGYYYYGMDV

SEQ ID NO: 4368 - protein, 12 aa, Artificial Sequence
  Description of Artificial Sequence: Synthetic peptide
RASQSFISSYLA

SEQ ID NO: 4369 - protein, 7 aa, Artificial Sequence
  Description of Artificial Sequence: Synthetic peptide
GASSRAT

SEQ ID NO: 4370 - protein, 9 aa, Artificial Sequence
  Description of Artificial Sequence: Synthetic peptide
QQSGNSPFT

SEQ ID NO: 4371 - protein, 6 aa, Artificial Sequence
  Description of Artificial Sequence: Synthetic peptide
SSYDMH

SEQ ID NO: 4372 - protein, 12 aa, Artificial Sequence
  Description of Artificial Sequence: Synthetic peptide
WVSTIGTAGDTY

SEQ ID NO: 4373 - protein, 11 aa, Artificial Sequence
  Description of Artificial Sequence: Synthetic peptide
ARGGYYYYGMD

SEQ ID NO: 4374 - protein, 8 aa, Artificial Sequence
  Description of Artificial Sequence: Synthetic peptide
ISSYLAWY

SEQ ID NO: 4375 - protein, 10 aa, Artificial Sequence
  Description of Artificial Sequence: Synthetic peptide
LLIYGASSRA

SEQ ID NO: 4376 - protein, 8 aa, Artificial Sequence
  Description of Artificial Sequence: Synthetic peptide
QQSGNSPF

SEQ ID NO: 4377 - protein, 8 aa, Artificial Sequence
  Description of Artificial Sequence: Synthetic peptide
GFTFSSYD

SEQ ID NO: 4378 - protein, 7 aa, Artificial Sequence
  Description of Artificial Sequence: Synthetic peptide
IGTAGDT

SEQ ID NO: 4379 - protein, 12 aa, Artificial Sequence
  Description of Artificial Sequence: Synthetic peptide
ARGGYYYYGMDV

SEQ ID NO: 4380 - protein, 7 aa, Artificial Sequence
  Description of Artificial Sequence: Synthetic peptide
QSFISSY

SEQ ID NO: 4381 - protein, 3 aa, Artificial Sequence
  Description of Artificial Sequence: Synthetic peptide
GAS

SEQ ID NO: 4382 - protein, 9 aa, Artificial Sequence
  Description of Artificial Sequence: Synthetic peptide
QQSGNSPFT

SEQ ID NO: 4383 - protein, 118 aa, Artificial Sequence
  Description of Artificial Sequence: Synthetic polypeptide
EVQLVESGGGLVQPGGSLRLSCAASGFTFSSYDMHWVRQVTGKGLEWVSTIGTAGDTYYPGSVKGRFTISRENAKNSLYLQMNSLRAGDTAVYYCARGGYYYYGMDVWGQGTTVTVSS

SEQ ID NO: 4384 - protein, 108 aa, Artificial Sequence
  Description of Artificial Sequence: Synthetic polypeptide
EIVLTQSPGTLSLSPGERATLSCRASQSFISSYLAWYQQKPGQAPRLLIYGASSRATGIPDRFSGSGSGTDFTLTISRLDPEDFAVYYCQQSGNSPFTFGPGTKVDVK

SEQ ID NO: 4385-4386 - skipped (2 entries)

SEQ ID NO: 4387 - protein, 5 aa, Artificial Sequence
  Description of Artificial Sequence: Synthetic peptide
NSDMH

SEQ ID NO: 4388 - protein, 16 aa, Artificial Sequence
  Description of Artificial Sequence: Synthetic peptide
TIGTAGDTYYPGSVKG

SEQ ID NO: 4389 - protein, 10 aa, Artificial Sequence
  Description of Artificial Sequence: Synthetic peptide
GGLYYYGMDV

SEQ ID NO: 4390 - protein, 12 aa, Artificial Sequence
  Description of Artificial Sequence: Synthetic peptide
RASQSVSSSYLA

SEQ ID NO: 4391 - protein, 7 aa, Artificial Sequence
  Description of Artificial Sequence: Synthetic peptide
GASSRAT

SEQ ID NO: 4392 - protein, 9 aa, Artificial Sequence
  Description of Artificial Sequence: Synthetic peptide
HQFGSSPFT

SEQ ID NO: 4393 - protein, 7 aa, Artificial Sequence
  Description of Artificial Sequence: Synthetic peptide
GFTFSNS

SEQ ID NO: 4394 - protein, 5 aa, Artificial Sequence
  Description of Artificial Sequence: Synthetic peptide
GTAGD

SEQ ID NO: 4395 - protein, 9 aa, Artificial Sequence
  Description of Artificial Sequence: Synthetic peptide
GGLYYYGMD

SEQ ID NO: 4396 - protein, 8 aa, Artificial Sequence
  Description of Artificial Sequence: Synthetic peptide
SQSVSSSY

SEQ ID NO: 4397 - protein, 3 aa, Artificial Sequence
  Description of Artificial Sequence: Synthetic peptide
GAS

SEQ ID NO: 4398 - protein, 6 aa, Artificial Sequence
  Description of Artificial Sequence: Synthetic peptide
FGSSPF

SEQ ID NO: 4399 - protein, 10 aa, Artificial Sequence
  Description of Artificial Sequence: Synthetic peptide
GFTFSNSDMH

SEQ ID NO: 4400 - protein, 9 aa, Artificial Sequence
  Description of Artificial Sequence: Synthetic peptide
TIGTAGDTY

SEQ ID NO: 4401 - protein, 10 aa, Artificial Sequence
  Description of Artificial Sequence: Synthetic peptide
GGLYYYGMDV

SEQ ID NO: 4402 - protein, 12 aa, Artificial Sequence
  Description of Artificial Sequence: Synthetic peptide
RASQSVSSSYLA

SEQ ID NO: 4403 - protein, 7 aa, Artificial Sequence
  Description of Artificial Sequence: Synthetic peptide
GASSRAT

SEQ ID NO: 4404 - protein, 9 aa, Artificial Sequence
  Description of Artificial Sequence: Synthetic peptide
HQFGSSPFT

SEQ ID NO: 4405 - protein, 6 aa, Artificial Sequence
  Description of Artificial Sequence: Synthetic peptide
SNSDMH

SEQ ID NO: 4406 - protein, 12 aa, Artificial Sequence
  Description of Artificial Sequence: Synthetic peptide
WVSTIGTAGDTY

SEQ ID NO: 4407 - protein, 11 aa, Artificial Sequence
  Description of Artificial Sequence: Synthetic peptide
ARGGLYYYGMD

SEQ ID NO: 4408 - protein, 8 aa, Artificial Sequence
  Description of Artificial Sequence: Synthetic peptide
SSSYLAWY

SEQ ID NO: 4409 - protein, 10 aa, Artificial Sequence
  Description of Artificial Sequence: Synthetic peptide
LLIYGASSRA

SEQ ID NO: 4410 - protein, 8 aa, Artificial Sequence
  Description of Artificial Sequence: Synthetic peptide
HQFGSSPF

SEQ ID NO: 4411 - protein, 8 aa, Artificial Sequence
  Description of Artificial Sequence: Synthetic peptide
GFTFSNSD

SEQ ID NO: 4412 - protein, 7 aa, Artificial Sequence
  Description of Artificial Sequence: Synthetic peptide
IGTAGDT

SEQ ID NO: 4413 - protein, 12 aa, Artificial Sequence
  Description of Artificial Sequence: Synthetic peptide
ARGGLYYYGMDV

SEQ ID NO: 4414 - protein, 7 aa, Artificial Sequence
  Description of Artificial Sequence: Synthetic peptide
QSVSSSY

SEQ ID NO: 4415 - protein, 3 aa, Artificial Sequence
  Description of Artificial Sequence: Synthetic peptide
GAS

SEQ ID NO: 4416 - protein, 9 aa, Artificial Sequence
  Description of Artificial Sequence: Synthetic peptide
HQFGSSPFT

SEQ ID NO: 4417 - protein, 118 aa, Artificial Sequence
  Description of Artificial Sequence: Synthetic polypeptide
EVQLVESGGGLVQPGGSLRLSCAASGFTFSNSDMHWVRQATGKGLEWVSTIGTAGDTYYPGSVKGRFTISRENAKNSLYLQMNSLRAGDTAVYYCARGGLYYYGMDVWGQGTTVTVSS

SEQ ID NO: 4418 - protein, 108 aa, Artificial Sequence
  Description of Artificial Sequence: Synthetic polypeptide
ENVLTQSPGTLSLSPGERATLSCRASQSVSSSYLAWYQQKPGQAPRLLIYGASSRATGIPDRFSGSGSGTDFTLTISRLEPEDFAVYYCHQFGSSPFTFGPGTKVDIK

SEQ ID NO: 4419-4420 - skipped (2 entries)

SEQ ID NO: 4421 - protein, 5 aa, Artificial Sequence
  Description of Artificial Sequence: Synthetic peptide
SYWMS

SEQ ID NO: 4422 - protein, 17 aa, Artificial Sequence
  Description of Artificial Sequence: Synthetic peptide
NINQDGNEKYYVDSVKG

SEQ ID NO: 4423 - protein, 10 aa, Artificial Sequence
  Description of Artificial Sequence: Synthetic peptide
EGGQWLALDY

SEQ ID NO: 4424 - protein, 11 aa, Artificial Sequence
  Description of Artificial Sequence: Synthetic peptide
RASQGISSWLA

SEQ ID NO: 4425 - protein, 7 aa, Artificial Sequence
  Description of Artificial Sequence: Synthetic peptide
GASSLQS

SEQ ID NO: 4426 - protein, 9 aa, Artificial Sequence
  Description of Artificial Sequence: Synthetic peptide
QQANSFPWT

SEQ ID NO: 4427 - protein, 7 aa, Artificial Sequence
  Description of Artificial Sequence: Synthetic peptide
GFTFSSY

SEQ ID NO: 4428 - protein, 6 aa, Artificial Sequence
  Description of Artificial Sequence: Synthetic peptide
NQDGNE

SEQ ID NO: 4429 - protein, 9 aa, Artificial Sequence
  Description of Artificial Sequence: Synthetic peptide
EGGQWLALD

SEQ ID NO: 4430 - protein, 7 aa, Artificial Sequence
  Description of Artificial Sequence: Synthetic peptide
SQGISSW

SEQ ID NO: 4431 - protein, 3 aa, Artificial Sequence
  Description of Artificial Sequence: Synthetic peptide
GAS

SEQ ID NO: 4432 - protein, 6 aa, Artificial Sequence
  Description of Artificial Sequence: Synthetic peptide
ANSFPW

SEQ ID NO: 4433 - protein, 10 aa, Artificial Sequence
  Description of Artificial Sequence: Synthetic peptide
GFTFSSYWMS

SEQ ID NO: 4434 - protein, 10 aa, Artificial Sequence
  Description of Artificial Sequence: Synthetic peptide
NINQDGNEKY

SEQ ID NO: 4435 - protein, 10 aa, Artificial Sequence
  Description of Artificial Sequence: Synthetic peptide
EGGQWLALDY

SEQ ID NO: 4436 - protein, 11 aa, Artificial Sequence
  Description of Artificial Sequence: Synthetic peptide
RASQGISSWLA

SEQ ID NO: 4437 - protein, 7 aa, Artificial Sequence
  Description of Artificial Sequence: Synthetic peptide
GASSLQS

SEQ ID NO: 4438 - protein, 9 aa, Artificial Sequence
  Description of Artificial Sequence: Synthetic peptide
QQANSFPWT

SEQ ID NO: 4439 - protein, 6 aa, Artificial Sequence
  Description of Artificial Sequence: Synthetic peptide
SSYWMS

SEQ ID NO: 4440 - protein, 13 aa, Artificial Sequence
  Description of Artificial Sequence: Synthetic peptide
WVANINQDGNEKY

SEQ ID NO: 4441 - protein, 11 aa, Artificial Sequence
  Description of Artificial Sequence: Synthetic peptide
AREGGQWLALD

SEQ ID NO: 4442 - protein, 7 aa, Artificial Sequence
  Description of Artificial Sequence: Synthetic peptide
SSWLAWY

SEQ ID NO: 4443 - protein, 10 aa, Artificial Sequence
  Description of Artificial Sequence: Synthetic peptide
FLISGASSLQ

SEQ ID NO: 4444 - protein, 8 aa, Artificial Sequence
  Description of Artificial Sequence: Synthetic peptide
QQANSFPW

SEQ ID NO: 4445 - protein, 8 aa, Artificial Sequence
  Description of Artificial Sequence: Synthetic peptide
GFTFSSYW

SEQ ID NO: 4446 - protein, 8 aa, Artificial Sequence
  Description of Artificial Sequence: Synthetic peptide
INQDGNEK

SEQ ID NO: 4447 - protein, 12 aa, Artificial Sequence
  Description of Artificial Sequence: Synthetic peptide
AREGGQWLALDY

SEQ ID NO: 4448 - protein, 6 aa, Artificial Sequence
  Description of Artificial Sequence: Synthetic peptide
QGISSW

SEQ ID NO: 4449 - protein, 3 aa, Artificial Sequence
  Description of Artificial Sequence: Synthetic peptide
GAS

SEQ ID NO: 4450 - protein, 9 aa, Artificial Sequence
  Description of Artificial Sequence: Synthetic peptide
QQANSFPWT

SEQ ID NO: 4451 - protein, 119 aa, Artificial Sequence
  Description of Artificial Sequence: Synthetic polypeptide
EVQLVESGGGLVQPGGSLRLSCAASGFTFSSYWMSWVRQAPGKGLEWVANINQDGNEKYYVDSVKGRFTISRDNAKNSLFLQMNSLRAEDTAVYYCAREGGQWLALDYWGQGALVTVSS

SEQ ID NO: 4452 - protein, 107 aa, Artificial Sequence
  Description of Artificial Sequence: Synthetic polypeptide
DIQMTQSPSSVSASVGDRVTITCRASQGISSWLAWYQQKPGKAPKFLISGASSLQSGVPSRFSGSGSGTDFTLTISSLQPEDFATYYCQQANSFPWTFGQGTKVEIK

SEQ ID NO: 4453-4454 - skipped (2 entries)

SEQ ID NO: 4455 - protein, 5 aa, Artificial Sequence
  Description of Artificial Sequence: Synthetic peptide
SYWMS

SEQ ID NO: 4456 - protein, 17 aa, Artificial Sequence
  Description of Artificial Sequence: Synthetic peptide
NIKEDGSDKYYVDSVKG

SEQ ID NO: 4457 - protein, 10 aa, Artificial Sequence
  Description of Artificial Sequence: Synthetic peptide
EGGQWLALDY

SEQ ID NO: 4458 - protein, 11 aa, Artificial Sequence
  Description of Artificial Sequence: Synthetic peptide
RASQGISSWLA

SEQ ID NO: 4459 - protein, 7 aa, Artificial Sequence
  Description of Artificial Sequence: Synthetic peptide
GASSLQS

SEQ ID NO: 4460 - protein, 9 aa, Artificial Sequence
  Description of Artificial Sequence: Synthetic peptide
QQANSFPWT

SEQ ID NO: 4461 - protein, 7 aa, Artificial Sequence
  Description of Artificial Sequence: Synthetic peptide
GFTFSSY

SEQ ID NO: 4462 - protein, 6 aa, Artificial Sequence
  Description of Artificial Sequence: Synthetic peptide
KEDGSD

SEQ ID NO: 4463 - protein, 9 aa, Artificial Sequence
  Description of Artificial Sequence: Synthetic peptide
EGGQWLALD

SEQ ID NO: 4464 - protein, 7 aa, Artificial Sequence
  Description of Artificial Sequence: Synthetic peptide
SQGISSW

SEQ ID NO: 4465 - protein, 3 aa, Artificial Sequence
  Description of Artificial Sequence: Synthetic peptide
GAS

SEQ ID NO: 4466 - protein, 6 aa, Artificial Sequence
  Description of Artificial Sequence: Synthetic peptide
ANSFPW

SEQ ID NO: 4467 - protein, 10 aa, Artificial Sequence
  Description of Artificial Sequence: Synthetic peptide
GFTFSSYWMS

SEQ ID NO: 4468 - protein, 10 aa, Artificial Sequence
  Description of Artificial Sequence: Synthetic peptide
NIKEDGSDKY

SEQ ID NO: 4469 - protein, 10 aa, Artificial Sequence
  Description of Artificial Sequence: Synthetic peptide
EGGQWLALDY

SEQ ID NO: 4470 - protein, 11 aa, Artificial Sequence
  Description of Artificial Sequence: Synthetic peptide
RASQGISSWLA

SEQ ID NO: 4471 - protein, 7 aa, Artificial Sequence
  Description of Artificial Sequence: Synthetic peptide
GASSLQS

SEQ ID NO: 4472 - protein, 9 aa, Artificial Sequence
  Description of Artificial Sequence: Synthetic peptide
QQANSFPWT

SEQ ID NO: 4473 - protein, 6 aa, Artificial Sequence
  Description of Artificial Sequence: Synthetic peptide
SSYWMS

SEQ ID NO: 4474 - protein, 13 aa, Artificial Sequence
  Description of Artificial Sequence: Synthetic peptide
WVANIKEDGSDKY

SEQ ID NO: 4475 - protein, 11 aa, Artificial Sequence
  Description of Artificial Sequence: Synthetic peptide
VREGGQWLALD

SEQ ID NO: 4476 - protein, 7 aa, Artificial Sequence
  Description of Artificial Sequence: Synthetic peptide
SSWLAWY

SEQ ID NO: 4477 - protein, 10 aa, Artificial Sequence
  Description of Artificial Sequence: Synthetic peptide
LLIYGASSLQ

SEQ ID NO: 4478 - protein, 8 aa, Artificial Sequence
  Description of Artificial Sequence: Synthetic peptide
QQANSFPW

SEQ ID NO: 4479 - protein, 8 aa, Artificial Sequence
  Description of Artificial Sequence: Synthetic peptide
GFTFSSYW

SEQ ID NO: 4480 - protein, 8 aa, Artificial Sequence
  Description of Artificial Sequence: Synthetic peptide
IKEDGSDK

SEQ ID NO: 4481 - protein, 12 aa, Artificial Sequence
  Description of Artificial Sequence: Synthetic peptide
VREGGQWLALDY

SEQ ID NO: 4482 - protein, 6 aa, Artificial Sequence
  Description of Artificial Sequence: Synthetic peptide
QGISSW

SEQ ID NO: 4483 - protein, 3 aa, Artificial Sequence
  Description of Artificial Sequence: Synthetic peptide
GAS

SEQ ID NO: 4484 - protein, 9 aa, Artificial Sequence
  Description of Artificial Sequence: Synthetic peptide
QQANSFPWT

SEQ ID NO: 4485 - protein, 119 aa, Artificial Sequence
  Description of Artificial Sequence: Synthetic polypeptide
EVQLVESGGGLVQPGGSLRLSCAASGFTFSSYWMSWVRQAPGKGLEWVANIKEDGSDKYYVDSVKGRFTISRDNAKNSLYLQMNSLRAEDTAVHYCVREGGQWLALDYWGQGTLVTVSS

SEQ ID NO: 4486 - protein, 107 aa, Artificial Sequence
  Description of Artificial Sequence: Synthetic polypeptide
DIQMTQSPSSVSGSVGDRVTITCRASQGISSWLAWYQQKPGKAPKLLIYGASSLQSGVPSRFSGSGSGTDFTLTISSLQPEDFVTYYCQQANSFPWTFGQGTKVEIK

SEQ ID NO: 4487-4488 - skipped (2 entries)

SEQ ID NO: 4489 - protein, 5 aa, Artificial Sequence
  Description of Artificial Sequence: Synthetic peptide
DYWMS

SEQ ID NO: 4490 - protein, 17 aa, Artificial Sequence
  Description of Artificial Sequence: Synthetic peptide
NIKEDGNEKYYVDSVKG

SEQ ID NO: 4491 - protein, 10 aa, Artificial Sequence
  Description of Artificial Sequence: Synthetic peptide
EGGQWLALDY

SEQ ID NO: 4492 - protein, 11 aa, Artificial Sequence
  Description of Artificial Sequence: Synthetic peptide
RASQGISSWLA

SEQ ID NO: 4493 - protein, 7 aa, Artificial Sequence
  Description of Artificial Sequence: Synthetic peptide
GASSLQS

SEQ ID NO: 4494 - protein, 9 aa, Artificial Sequence
  Description of Artificial Sequence: Synthetic peptide
QQANSFPWT

SEQ ID NO: 4495 - protein, 7 aa, Artificial Sequence
  Description of Artificial Sequence: Synthetic peptide
GFTFSDY

SEQ ID NO: 4496 - protein, 6 aa, Artificial Sequence
  Description of Artificial Sequence: Synthetic peptide
KEDGNE

SEQ ID NO: 4497 - protein, 9 aa, Artificial Sequence
  Description of Artificial Sequence: Synthetic peptide
EGGQWLALD

SEQ ID NO: 4498 - protein, 7 aa, Artificial Sequence
  Description of Artificial Sequence: Synthetic peptide
SQGISSW

SEQ ID NO: 4499 - protein, 3 aa, Artificial Sequence
  Description of Artificial Sequence: Synthetic peptide
GAS

SEQ ID NO: 4500 - protein, 6 aa, Artificial Sequence
  Description of Artificial Sequence: Synthetic peptide
ANSFPW

SEQ ID NO: 4501 - protein, 10 aa, Artificial Sequence
  Description of Artificial Sequence: Synthetic peptide
GFTFSDYWMS

SEQ ID NO: 4502 - protein, 10 aa, Artificial Sequence
  Description of Artificial Sequence: Synthetic peptide
NIKEDGNEKY

SEQ ID NO: 4503 - protein, 10 aa, Artificial Sequence
  Description of Artificial Sequence: Synthetic peptide
EGGQWLALDY

SEQ ID NO: 4504 - protein, 11 aa, Artificial Sequence
  Description of Artificial Sequence: Synthetic peptide
RASQGISSWLA

SEQ ID NO: 4505 - protein, 7 aa, Artificial Sequence
  Description of Artificial Sequence: Synthetic peptide
GASSLQS

SEQ ID NO: 4506 - protein, 9 aa, Artificial Sequence
  Description of Artificial Sequence: Synthetic peptide
QQANSFPWT

SEQ ID NO: 4507 - protein, 6 aa, Artificial Sequence
  Description of Artificial Sequence: Synthetic peptide
SDYWMS

SEQ ID NO: 4508 - protein, 13 aa, Artificial Sequence
  Description of Artificial Sequence: Synthetic peptide
WVANIKEDGNEKY

SEQ ID NO: 4509 - protein, 11 aa, Artificial Sequence
  Description of Artificial Sequence: Synthetic peptide
AREGGQWLALD

SEQ ID NO: 4510 - protein, 7 aa, Artificial Sequence
  Description of Artificial Sequence: Synthetic peptide
SSWLAWY

SEQ ID NO: 4511 - protein, 10 aa, Artificial Sequence
  Description of Artificial Sequence: Synthetic peptide
FLISGASSLQ

SEQ ID NO: 4512 - protein, 8 aa, Artificial Sequence
  Description of Artificial Sequence: Synthetic peptide
QQANSFPW

SEQ ID NO: 4513 - protein, 8 aa, Artificial Sequence
  Description of Artificial Sequence: Synthetic peptide
GFTFSDYW

SEQ ID NO: 4514 - protein, 8 aa, Artificial Sequence
  Description of Artificial Sequence: Synthetic peptide
IKEDGNEK

SEQ ID NO: 4515 - protein, 12 aa, Artificial Sequence
  Description of Artificial Sequence: Synthetic peptide
AREGGQWLALDY

SEQ ID NO: 4516 - protein, 6 aa, Artificial Sequence
  Description of Artificial Sequence: Synthetic peptide
QGISSW

SEQ ID NO: 4517 - protein, 3 aa, Artificial Sequence
  Description of Artificial Sequence: Synthetic peptide
GAS

SEQ ID NO: 4518 - protein, 9 aa, Artificial Sequence
  Description of Artificial Sequence: Synthetic peptide
QQANSFPWT

SEQ ID NO: 4519 - protein, 119 aa, Artificial Sequence
  Description of Artificial Sequence: Synthetic polypeptide
EVQLVESGGGLVQPGGSLRLSCAASGFTFSDYWMSWVRQAPGKGLEWVANIKEDGNEKYYVDSVKGRFTISRDNAKNSLFLQMNSLRAEDTAVYYCAREGGQWLALDYWGQGALVTVSS

SEQ ID NO: 4520 - protein, 107 aa, Artificial Sequence
  Description of Artificial Sequence: Synthetic polypeptide
DIQMTQSPSSVSASVGDRVTITCRASQGISSWLAWYQQKPGKAPKFLISGASSLQSGVPSRFTGSGSGTDFTLTISSLQPEDFATYYCQQANSFPWTFGQGTKVEIK

SEQ ID NO: 4521-4522 - skipped (2 entries)

SEQ ID NO: 4523 - protein, 5 aa, Artificial Sequence
  Description of Artificial Sequence: Synthetic peptide
SYWMS

SEQ ID NO: 4524 - protein, 17 aa, Artificial Sequence
  Description of Artificial Sequence: Synthetic peptide
NINEDGNEKYHVDSVKG

SEQ ID NO: 4525 - protein, 10 aa, Artificial Sequence
  Description of Artificial Sequence: Synthetic peptide
EGGQWLALDY

SEQ ID NO: 4526 - protein, 11 aa, Artificial Sequence
  Description of Artificial Sequence: Synthetic peptide
RASQGISSWLA

SEQ ID NO: 4527 - protein, 7 aa, Artificial Sequence
  Description of Artificial Sequence: Synthetic peptide
GASGLQS

SEQ ID NO: 4528 - protein, 9 aa, Artificial Sequence
  Description of Artificial Sequence: Synthetic peptide
QQANSFPWT

SEQ ID NO: 4529 - protein, 7 aa, Artificial Sequence
  Description of Artificial Sequence: Synthetic peptide
GFTFSSY

SEQ ID NO: 4530 - protein, 6 aa, Artificial Sequence
  Description of Artificial Sequence: Synthetic peptide
NEDGNE

SEQ ID NO: 4531 - protein, 9 aa, Artificial Sequence
  Description of Artificial Sequence: Synthetic peptide
EGGQWLALD

SEQ ID NO: 4532 - protein, 7 aa, Artificial Sequence
  Description of Artificial Sequence: Synthetic peptide
SQGISSW

SEQ ID NO: 4533 - protein, 3 aa, Artificial Sequence
  Description of Artificial Sequence: Synthetic peptide
GAS

SEQ ID NO: 4534 - protein, 6 aa, Artificial Sequence
  Description of Artificial Sequence: Synthetic peptide
ANSFPW

SEQ ID NO: 4535 - protein, 10 aa, Artificial Sequence
  Description of Artificial Sequence: Synthetic peptide
GFTFSSYWMS

SEQ ID NO: 4536 - protein, 10 aa, Artificial Sequence
  Description of Artificial Sequence: Synthetic peptide
NINEDGNEKY

SEQ ID NO: 4537 - protein, 10 aa, Artificial Sequence
  Description of Artificial Sequence: Synthetic peptide
EGGQWLALDY

SEQ ID NO: 4538 - protein, 11 aa, Artificial Sequence
  Description of Artificial Sequence: Synthetic peptide
RASQGISSWLA

SEQ ID NO: 4539 - protein, 7 aa, Artificial Sequence
  Description of Artificial Sequence: Synthetic peptide
GASGLQS

SEQ ID NO: 4540 - protein, 9 aa, Artificial Sequence
  Description of Artificial Sequence: Synthetic peptide
QQANSFPWT

SEQ ID NO: 4541 - protein, 6 aa, Artificial Sequence
  Description of Artificial Sequence: Synthetic peptide
SSYWMS

SEQ ID NO: 4542 - protein, 13 aa, Artificial Sequence
  Description of Artificial Sequence: Synthetic peptide
WVANINEDGNEKY

SEQ ID NO: 4543 - protein, 11 aa, Artificial Sequence
  Description of Artificial Sequence: Synthetic peptide
AREGGQWLALD

SEQ ID NO: 4544 - protein, 7 aa, Artificial Sequence
  Description of Artificial Sequence: Synthetic peptide
SSWLAWY

SEQ ID NO: 4545 - protein, 10 aa, Artificial Sequence
  Description of Artificial Sequence: Synthetic peptide
LLIYGASGLQ

SEQ ID NO: 4546 - protein, 8 aa, Artificial Sequence
  Description of Artificial Sequence: Synthetic peptide
QQANSFPW

SEQ ID NO: 4547 - protein, 8 aa, Artificial Sequence
  Description of Artificial Sequence: Synthetic peptide
GFTFSSYW

SEQ ID NO: 4548 - protein, 8 aa, Artificial Sequence
  Description of Artificial Sequence: Synthetic peptide
INEDGNEK

SEQ ID NO: 4549 - protein, 12 aa, Artificial Sequence
  Description of Artificial Sequence: Synthetic peptide
AREGGQWLALDY

SEQ ID NO: 4550 - protein, 6 aa, Artificial Sequence
  Description of Artificial Sequence: Synthetic peptide
QGISSW

SEQ ID NO: 4551 - protein, 3 aa, Artificial Sequence
  Description of Artificial Sequence: Synthetic peptide
GAS

SEQ ID NO: 4552 - protein, 9 aa, Artificial Sequence
  Description of Artificial Sequence: Synthetic peptide
QQANSFPWT

SEQ ID NO: 4553 - protein, 119 aa, Artificial Sequence
  Description of Artificial Sequence: Synthetic polypeptide
EVQLVESGGGLVQPGGSLRLSCAASGFTFSSYWMSWVRQAPGQGLEWVANINEDGNEKYHVDSVKGRLTISRDNAKNSLYLQMNSLRGVDTAVYFCAREGGQWLALDYWGQGALVTVSS

SEQ ID NO: 4554 - protein, 107 aa, Artificial Sequence
  Description of Artificial Sequence: Synthetic polypeptide
DIQMTQSPSSVSASVGDRVSITCRASQGISSWLAWYQQKPGKAPKLLIYGASGLQSGVPSRFSGSGSGTDFTLTISSLQPEDFATYYCQQANSFPWTFGQGTKVEIK

SEQ ID NO: 4555-4556 - skipped (2 entries)

SEQ ID NO: 4557 - protein, 5 aa, Artificial Sequence
  Description of Artificial Sequence: Synthetic peptide
GYYWS

SEQ ID NO: 4558 - protein, 16 aa, Artificial Sequence
  Description of Artificial Sequence: Synthetic peptide
EINHSGSTNCNPSLKS

SEQ ID NO: 4559 - protein, 7 aa, Artificial Sequence
  Description of Artificial Sequence: Synthetic peptide
VLNYFDY

SEQ ID NO: 4560 - protein, 11 aa, Artificial Sequence
  Description of Artificial Sequence: Synthetic peptide
RASPDIANWLA

SEQ ID NO: 4561 - protein, 7 aa, Artificial Sequence
  Description of Artificial Sequence: Synthetic peptide
AASSLQS

SEQ ID NO: 4562 - protein, 9 aa, Artificial Sequence
  Description of Artificial Sequence: Synthetic peptide
QQANSFPLT

SEQ ID NO: 4563 - protein, 7 aa, Artificial Sequence
  Description of Artificial Sequence: Synthetic peptide
GGSFSGY

SEQ ID NO: 4564 - protein, 5 aa, Artificial Sequence
  Description of Artificial Sequence: Synthetic peptide
NHSGS

SEQ ID NO: 4565 - protein, 6 aa, Artificial Sequence
  Description of Artificial Sequence: Synthetic peptide
VLNYFD

SEQ ID NO: 4566 - protein, 7 aa, Artificial Sequence
  Description of Artificial Sequence: Synthetic peptide
SPDIANW

SEQ ID NO: 4567 - protein, 3 aa, Artificial Sequence
  Description of Artificial Sequence: Synthetic peptide
AAS

SEQ ID NO: 4568 - protein, 6 aa, Artificial Sequence
  Description of Artificial Sequence: Synthetic peptide
ANSFPL

SEQ ID NO: 4569 - protein, 10 aa, Artificial Sequence
  Description of Artificial Sequence: Synthetic peptide
GGSFSGYYWS

SEQ ID NO: 4570 - protein, 9 aa, Artificial Sequence
  Description of Artificial Sequence: Synthetic peptide
EINHSGSTN

SEQ ID NO: 4571 - protein, 7 aa, Artificial Sequence
  Description of Artificial Sequence: Synthetic peptide
VLNYFDY

SEQ ID NO: 4572 - protein, 11 aa, Artificial Sequence
  Description of Artificial Sequence: Synthetic peptide
RASPDIANWLA

SEQ ID NO: 4573 - protein, 7 aa, Artificial Sequence
  Description of Artificial Sequence: Synthetic peptide
AASSLQS

SEQ ID NO: 4574 - protein, 9 aa, Artificial Sequence
  Description of Artificial Sequence: Synthetic peptide
QQANSFPLT

SEQ ID NO: 4575 - protein, 6 aa, Artificial Sequence
  Description of Artificial Sequence: Synthetic peptide
SGYYWS

SEQ ID NO: 4576 - protein, 12 aa, Artificial Sequence
  Description of Artificial Sequence: Synthetic peptide
WIGEINHSGSTN

SEQ ID NO: 4577 - protein, 8 aa, Artificial Sequence
  Description of Artificial Sequence: Synthetic peptide
ARVLNYFD

SEQ ID NO: 4578 - protein, 7 aa, Artificial Sequence
  Description of Artificial Sequence: Synthetic peptide
ANWLAWY

SEQ ID NO: 4579 - protein, 10 aa, Artificial Sequence
  Description of Artificial Sequence: Synthetic peptide
LLIYAASSLQ

SEQ ID NO: 4580 - protein, 8 aa, Artificial Sequence
  Description of Artificial Sequence: Synthetic peptide
QQANSFPL

SEQ ID NO: 4581 - protein, 8 aa, Artificial Sequence
  Description of Artificial Sequence: Synthetic peptide
GGSFSGYY

SEQ ID NO: 4582 - protein, 7 aa, Artificial Sequence
  Description of Artificial Sequence: Synthetic peptide
INHSGST

SEQ ID NO: 4583 - protein, 9 aa, Artificial Sequence
  Description of Artificial Sequence: Synthetic peptide
ARVLNYFDY

SEQ ID NO: 4584 - protein, 6 aa, Artificial Sequence
  Description of Artificial Sequence: Synthetic peptide
PDIANW

SEQ ID NO: 4585 - protein, 3 aa, Artificial Sequence
  Description of Artificial Sequence: Synthetic peptide
AAS

SEQ ID NO: 4586 - protein, 9 aa, Artificial Sequence
  Description of Artificial Sequence: Synthetic peptide
QQANSFPLT

SEQ ID NO: 4587 - protein, 115 aa, Artificial Sequence
  Description of Artificial Sequence: Synthetic polypeptide
QVQLQQWGAGLLKPSETLSLTCAVSGGSFSGYYWSWIRQPPGKGLEWIGEINHSGSTNCNPSLKSRVTISVDTSNNQFSLKLSSVTAADTAVYYCARVLNYFDYWGQGTLVTVSS

SEQ ID NO: 4588 - protein, 107 aa, Artificial Sequence
  Description of Artificial Sequence: Synthetic polypeptide
DIQMTQSPSSVSASVGDRVTITCRASPDIANWLAWYQQKPGKAPELLIYAASSLQSGVPSRFSGSGSGTDFTLTISSLQPEDFATYFCQQANSFPLTFGGGTKVESK

SEQ ID NO: 4589 - protein, 445 aa, Artificial Sequence
  Description of Artificial Sequence: Synthetic peptide
QVQLQQWGAGLLKPSETLSLTCAVSGGSFSGYYWSWIRQPPGKGLEWIGEINHSGSTNCNPSLKSRVTISVDTSNNQFSLKLSSVTAADTAVYYCARVLNYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4590 - protein, 214 aa, Artificial Sequence
  Description of Artificial Sequence: Synthetic peptide
DIQMTQSPSSVSASVGDRVTITCRASPDIANWLAWYQQKPGKAPELLIYAASSLQSGVPSRFSGSGSGTDFTLTISSLQPEDFATYFCQQANSFPLTFGGGTKVESKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4591 - protein, 5 aa, Artificial Sequence
  Description of Artificial Sequence: Synthetic peptide
NYDMH

SEQ ID NO: 4592 - protein, 16 aa, Artificial Sequence
  Description of Artificial Sequence: Synthetic peptide
TIGTAGDTYYPGSVKG

SEQ ID NO: 4593 - protein, 10 aa, Artificial Sequence
  Description of Artificial Sequence: Synthetic peptide
GAYGYYGMDV

SEQ ID NO: 4594 - protein, 12 aa, Artificial Sequence
  Description of Artificial Sequence: Synthetic peptide
RASQSVSSSYLA

SEQ ID NO: 4595 - protein, 7 aa, Artificial Sequence
  Description of Artificial Sequence: Synthetic peptide
GASSRAT

SEQ ID NO: 4596 - protein, 9 aa, Artificial Sequence
  Description of Artificial Sequence: Synthetic peptide
QQYGFSPFT

SEQ ID NO: 4597 - protein, 7 aa, Artificial Sequence
  Description of Artificial Sequence: Synthetic peptide
GFTFSNY

SEQ ID NO: 4598 - protein, 5 aa, Artificial Sequence
  Description of Artificial Sequence: Synthetic peptide
GTAGD

SEQ ID NO: 4599 - protein, 9 aa, Artificial Sequence
  Description of Artificial Sequence: Synthetic peptide
GAYGYYGMD

SEQ ID NO: 4600 - protein, 8 aa, Artificial Sequence
  Description of Artificial Sequence: Synthetic peptide
SQSVSSSY

SEQ ID NO: 4601 - protein, 3 aa, Artificial Sequence
  Description of Artificial Sequence: Synthetic peptide
GAS

SEQ ID NO: 4602 - protein, 6 aa, Artificial Sequence
  Description of Artificial Sequence: Synthetic peptide
YGFSPF

SEQ ID NO: 4603 - protein, 10 aa, Artificial Sequence
  Description of Artificial Sequence: Synthetic peptide
GFTFSNYDMH

SEQ ID NO: 4604 - protein, 9 aa, Artificial Sequence
  Description of Artificial Sequence: Synthetic peptide
TIGTAGDTY

SEQ ID NO: 4605 - protein, 10 aa, Artificial Sequence
  Description of Artificial Sequence: Synthetic peptide
GAYGYYGMDV

SEQ ID NO: 4606 - protein, 12 aa, Artificial Sequence
  Description of Artificial Sequence: Synthetic peptide
RASQSVSSSYLA

SEQ ID NO: 4607 - protein, 7 aa, Artificial Sequence
  Description of Artificial Sequence: Synthetic peptide
GASSRAT

SEQ ID NO: 4608 - protein, 9 aa, Artificial Sequence
  Description of Artificial Sequence: Synthetic peptide
QQYGFSPFT

SEQ ID NO: 4609 - protein, 6 aa, Artificial Sequence
  Description of Artificial Sequence: Synthetic peptide
SNYDMH

SEQ ID NO: 4610 - protein, 12 aa, Artificial Sequence
  Description of Artificial Sequence: Synthetic peptide
WVSTIGTAGDTY

SEQ ID NO: 4611 - protein, 11 aa, Artificial Sequence
  Description of Artificial Sequence: Synthetic peptide
ARGAYGYYGMD

SEQ ID NO: 4612 - protein, 8 aa, Artificial Sequence
  Description of Artificial Sequence: Synthetic peptide
SSSYLAWY

SEQ ID NO: 4613 - protein, 10 aa, Artificial Sequence
  Description of Artificial Sequence: Synthetic peptide
LLIYGASSRA

SEQ ID NO: 4614 - protein, 8 aa, Artificial Sequence
  Description of Artificial Sequence: Synthetic peptide
QQYGFSPF

SEQ ID NO: 4615 - protein, 8 aa, Artificial Sequence
  Description of Artificial Sequence: Synthetic peptide
GFTFSNYD

SEQ ID NO: 4616 - protein, 7 aa, Artificial Sequence
  Description of Artificial Sequence: Synthetic peptide
IGTAGDT

SEQ ID NO: 4617 - protein, 12 aa, Artificial Sequence
  Description of Artificial Sequence: Synthetic peptide
ARGAYGYYGMDV

SEQ ID NO: 4618 - protein, 7 aa, Artificial Sequence
  Description of Artificial Sequence: Synthetic peptide
QSVSSSY

SEQ ID NO: 4619 - protein, 3 aa, Artificial Sequence
  Description of Artificial Sequence: Synthetic peptide
GAS

SEQ ID NO: 4620 - protein, 9 aa, Artificial Sequence
  Description of Artificial Sequence: Synthetic peptide
QQYGFSPFT

SEQ ID NO: 4621 - protein, 118 aa, Artificial Sequence
  Description of Artificial Sequence: Synthetic polypeptide
EVQLVESGGVLVQPGGSLRLSCAASGFTFSNYDMHWVRQATGKGLEWVSTIGTAGDTYYPGSVKGRFTLSRENAKNSLYLQMHSLRAGDTAVYYCARGAYGYYGMDVWGQGTTVTVSS

SEQ ID NO: 4622 - protein, 108 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFILTISRLEPEDFAVYYCQQYGFSPFTFGPGTKVDIK

SEQ ID NO: 4623-4624 - skipped (2 entries)

SEQ ID NO: 4625 - protein, 5 aa, Artificial Sequence
  Description of Artificial Sequence: Synthetic peptide
GYYWS

SEQ ID NO: 4626 - protein, 16 aa, Artificial Sequence
  Description of Artificial Sequence: Synthetic peptide
EINHSGSTNCNPSLKS

SEQ ID NO: 4627 - protein, 7 aa, Artificial Sequence
  Description of Artificial Sequence: Synthetic peptide
VLNFFDY

SEQ ID NO: 4628 - protein, 11 aa, Artificial Sequence
  Description of Artificial Sequence: Synthetic peptide
RASPGISNWLA

SEQ ID NO: 4629 - protein, 7 aa, Artificial Sequence
  Description of Artificial Sequence: Synthetic peptide
AASSLQS

SEQ ID NO: 4630 - protein, 9 aa, Artificial Sequence
  Description of Artificial Sequence: Synthetic peptide
QQANSFPLT

SEQ ID NO: 4631 - protein, 7 aa, Artificial Sequence
  Description of Artificial Sequence: Synthetic peptide
GGSFSGY

SEQ ID NO: 4632 - protein, 5 aa, Artificial Sequence
  Description of Artificial Sequence: Synthetic peptide
NHSGS

SEQ ID NO: 4633 - protein, 6 aa, Artificial Sequence
  Description of Artificial Sequence: Synthetic peptide
VLNFFD

SEQ ID NO: 4634 - protein, 7 aa, Artificial Sequence
  Description of Artificial Sequence: Synthetic peptide
SPGISNW

SEQ ID NO: 4635 - protein, 3 aa, Artificial Sequence
  Description of Artificial Sequence: Synthetic peptide
AAS

SEQ ID NO: 4636 - protein, 6 aa, Artificial Sequence
  Description of Artificial Sequence: Synthetic peptide
ANSFPL

SEQ ID NO: 4637 - protein, 10 aa, Artificial Sequence
  Description of Artificial Sequence: Synthetic peptide
GGSFSGYYWS

SEQ ID NO: 4638 - protein, 9 aa, Artificial Sequence
  Description of Artificial Sequence: Synthetic peptide
EINHSGSTN

SEQ ID NO: 4639 - protein, 7 aa, Artificial Sequence
  Description of Artificial Sequence: Synthetic peptide
VLNFFDY

SEQ ID NO: 4640 - protein, 11 aa, Artificial Sequence
  Description of Artificial Sequence: Synthetic peptide
RASPGISNWLA

SEQ ID NO: 4641 - protein, 7 aa, Artificial Sequence
  Description of Artificial Sequence: Synthetic peptide
AASSLQS

SEQ ID NO: 4642 - protein, 9 aa, Artificial Sequence
  Description of Artificial Sequence: Synthetic peptide
QQANSFPLT

SEQ ID NO: 4643 - protein, 6 aa, Artificial Sequence
  Description of Artificial Sequence: Synthetic peptide
SGYYWS

SEQ ID NO: 4644 - protein, 12 aa, Artificial Sequence
  Description of Artificial Sequence: Synthetic peptide
WIGEINHSGSTN

SEQ ID NO: 4645 - protein, 8 aa, Artificial Sequence
  Description of Artificial Sequence: Synthetic peptide
ARVLNFFD

SEQ ID NO: 4646 - protein, 7 aa, Artificial Sequence
  Description of Artificial Sequence: Synthetic peptide
SNWLAWY

SEQ ID NO: 4647 - protein, 10 aa, Artificial Sequence
  Description of Artificial Sequence: Synthetic peptide
LLIYAASSLQ

SEQ ID NO: 4648 - protein, 8 aa, Artificial Sequence
  Description of Artificial Sequence: Synthetic peptide
QQANSFPL

SEQ ID NO: 4649 - protein, 8 aa, Artificial Sequence
  Description of Artificial Sequence: Synthetic peptide
GGSFSGYY

SEQ ID NO: 4650 - protein, 7 aa, Artificial Sequence
  Description of Artificial Sequence: Synthetic peptide
INHSGST

SEQ ID NO: 4651 - protein, 9 aa, Artificial Sequence
  Description of Artificial Sequence: Synthetic peptide
ARVLNFFDY

SEQ ID NO: 4652 - protein, 6 aa, Artificial Sequence
  Description of Artificial Sequence: Synthetic peptide
PGISNW

SEQ ID NO: 4653 - protein, 3 aa, Artificial Sequence
  Description of Artificial Sequence: Synthetic peptide
AAS

SEQ ID NO: 4654 - protein, 9 aa, Artificial Sequence
  Description of Artificial Sequence: Synthetic peptide
QQANSFPLT

SEQ ID NO: 4655 - protein, 115 aa, Artificial Sequence
  Description of Artificial Sequence: Synthetic polypeptide
QVQLQQWGAGLLKPSETLSLTCAVSGGSFSGYYWSWIRQPPGKGLEWIGEINHSGSTNCNPSLKSRVTISVDTSKNQFSLKLSSVTAADTAMYYCARVLNFFDYWGQGTLVTVSS

SEQ ID NO: 4656 - protein, 107 aa, Artificial Sequence
  Description of Artificial Sequence: Synthetic polypeptide
DIQMTQTPSSVSASVGDRVTITCRASPGISNWLAWYQQKPGKAPELLIYAASSLQSGVPSRFSGSGSGTDFTLTISSLQPEDFATYFCQQANSFPLTFGGGTKVESK

SEQ ID NO: 4657-4658 - skipped (2 entries)

SEQ ID NO: 4659 - protein, 5 aa, Artificial Sequence
  Description of Artificial Sequence: Synthetic peptide
GYYWS

SEQ ID NO: 4660 - protein, 16 aa, Artificial Sequence
  Description of Artificial Sequence: Synthetic peptide
EINHSGSTNCNPSLKS

SEQ ID NO: 4661 - protein, 7 aa, Artificial Sequence
  Description of Artificial Sequence: Synthetic peptide
VLNYFDY

SEQ ID NO: 4662 - protein, 11 aa, Artificial Sequence
  Description of Artificial Sequence: Synthetic peptide
RASPDIANWLA

SEQ ID NO: 4663 - protein, 7 aa, Artificial Sequence
  Description of Artificial Sequence: Synthetic peptide
AASSLQS

SEQ ID NO: 4664 - protein, 9 aa, Artificial Sequence
  Description of Artificial Sequence: Synthetic peptide
QQANSFPLT

SEQ ID NO: 4665 - protein, 7 aa, Artificial Sequence
  Description of Artificial Sequence: Synthetic peptide
GGSFSGY

SEQ ID NO: 4666 - protein, 5 aa, Artificial Sequence
  Description of Artificial Sequence: Synthetic peptide
NHSGS

SEQ ID NO: 4667 - protein, 6 aa, Artificial Sequence
  Description of Artificial Sequence: Synthetic peptide
VLNYFD

SEQ ID NO: 4668 - protein, 7 aa, Artificial Sequence
  Description of Artificial Sequence: Synthetic peptide
SPDIANW

SEQ ID NO: 4669 - protein, 3 aa, Artificial Sequence
  Description of Artificial Sequence: Synthetic peptide
AAS

SEQ ID NO: 4670 - protein, 6 aa, Artificial Sequence
  Description of Artificial Sequence: Synthetic peptide
ANSFPL

SEQ ID NO: 4671 - protein, 10 aa, Artificial Sequence
  Description of Artificial Sequence: Synthetic peptide
GGSFSGYYWS

SEQ ID NO: 4672 - protein, 9 aa, Artificial Sequence
  Description of Artificial Sequence: Synthetic peptide
EINHSGSTN

SEQ ID NO: 4673 - protein, 7 aa, Artificial Sequence
  Description of Artificial Sequence: Synthetic peptide
VLNYFDY

SEQ ID NO: 4674 - protein, 11 aa, Artificial Sequence
  Description of Artificial Sequence: Synthetic peptide
RASPDIANWLA

SEQ ID NO: 4675 - protein, 7 aa, Artificial Sequence
  Description of Artificial Sequence: Synthetic peptide
AASSLQS

SEQ ID NO: 4676 - protein, 9 aa, Artificial Sequence
  Description of Artificial Sequence: Synthetic peptide
QQANSFPLT

SEQ ID NO: 4677 - protein, 6 aa, Artificial Sequence
  Description of Artificial Sequence: Synthetic peptide
SGYYWS

SEQ ID NO: 4678 - protein, 12 aa, Artificial Sequence
  Description of Artificial Sequence: Synthetic peptide
WIGEINHSGSTN

SEQ ID NO: 4679 - protein, 8 aa, Artificial Sequence
  Description of Artificial Sequence: Synthetic peptide
ARVLNYFD

SEQ ID NO: 4680 - protein, 7 aa, Artificial Sequence
  Description of Artificial Sequence: Synthetic peptide
ANWLAWY

SEQ ID NO: 4681 - protein, 10 aa, Artificial Sequence
  Description of Artificial Sequence: Synthetic peptide
LLIYAASSLQ

SEQ ID NO: 4682 - protein, 8 aa, Artificial Sequence
  Description of Artificial Sequence: Synthetic peptide
QQANSFPL

SEQ ID NO: 4683 - protein, 8 aa, Artificial Sequence
  Description of Artificial Sequence: Synthetic peptide
GGSFSGYY

SEQ ID NO: 4684 - protein, 7 aa, Artificial Sequence
  Description of Artificial Sequence: Synthetic peptide
INHSGST

SEQ ID NO: 4685 - protein, 9 aa, Artificial Sequence
  Description of Artificial Sequence: Synthetic peptide
ARVLNYFDY

SEQ ID NO: 4686 - protein, 6 aa, Artificial Sequence
  Description of Artificial Sequence: Synthetic peptide
PDIANW

SEQ ID NO: 4687 - protein, 3 aa, Artificial Sequence
  Description of Artificial Sequence: Synthetic peptide
AAS

SEQ ID NO: 4688 - protein, 9 aa, Artificial Sequence
  Description of Artificial Sequence: Synthetic peptide
QQANSFPLT

SEQ ID NO: 4689 - protein, 115 aa, Artificial Sequence; identical to SEQ ID NO: 4587
  Description of Artificial Sequence: Synthetic polypeptide

SEQ ID NO: 4690 - protein, 107 aa, Artificial Sequence; identical to SEQ ID NO: 4588
  Description of Artificial Sequence: Synthetic polypeptide

SEQ ID NO: 4691-4692 - skipped (2 entries)

SEQ ID NO: 4693 - protein, 5 aa, Artificial Sequence
  Description of Artificial Sequence: Synthetic peptide
GYYWS

SEQ ID NO: 4694 - protein, 16 aa, Artificial Sequence
  Description of Artificial Sequence: Synthetic peptide
EINQSGNTNYNPSLKS

SEQ ID NO: 4695 - protein, 7 aa, Artificial Sequence
  Description of Artificial Sequence: Synthetic peptide
VLNWFDY

SEQ ID NO: 4696 - protein, 11 aa, Artificial Sequence
  Description of Artificial Sequence: Synthetic peptide
RASQGISDWLA

SEQ ID NO: 4697 - protein, 7 aa, Artificial Sequence
  Description of Artificial Sequence: Synthetic peptide
AASSLQS

SEQ ID NO: 4698 - protein, 9 aa, Artificial Sequence
  Description of Artificial Sequence: Synthetic peptide
QQANSFPYT

SEQ ID NO: 4699 - protein, 7 aa, Artificial Sequence
  Description of Artificial Sequence: Synthetic peptide
GGSFSGY

SEQ ID NO: 4700 - protein, 5 aa, Artificial Sequence
  Description of Artificial Sequence: Synthetic peptide
NQSGN

SEQ ID NO: 4701 - protein, 6 aa, Artificial Sequence
  Description of Artificial Sequence: Synthetic peptide
VLNWFD

SEQ ID NO: 4702 - protein, 7 aa, Artificial Sequence
  Description of Artificial Sequence: Synthetic peptide
SQGISDW

SEQ ID NO: 4703 - protein, 3 aa, Artificial Sequence
  Description of Artificial Sequence: Synthetic peptide
AAS

SEQ ID NO: 4704 - protein, 6 aa, Artificial Sequence
  Description of Artificial Sequence: Synthetic peptide
ANSFPY

SEQ ID NO: 4705 - protein, 10 aa, Artificial Sequence
  Description of Artificial Sequence: Synthetic peptide
GGSFSGYYWS

SEQ ID NO: 4706 - protein, 9 aa, Artificial Sequence
  Description of Artificial Sequence: Synthetic peptide
EINQSGNTN

SEQ ID NO: 4707 - protein, 7 aa, Artificial Sequence
  Description of Artificial Sequence: Synthetic peptide
VLNWFDY

SEQ ID NO: 4708 - protein, 11 aa, Artificial Sequence
  Description of Artificial Sequence: Synthetic peptide
RASQGISDWLA

SEQ ID NO: 4709 - protein, 7 aa, Artificial Sequence
  Description of Artificial Sequence: Synthetic peptide
AASSLQS

SEQ ID NO: 4710 - protein, 9 aa, Artificial Sequence
  Description of Artificial Sequence: Synthetic peptide
QQANSFPYT

SEQ ID NO: 4711 - protein, 6 aa, Artificial Sequence
  Description of Artificial Sequence: Synthetic peptide
SGYYWS

SEQ ID NO: 4712 - protein, 12 aa, Artificial Sequence
  Description of Artificial Sequence: Synthetic peptide
WIGEINQSGNTN

SEQ ID NO: 4713 - protein, 8 aa, Artificial Sequence
  Description of Artificial Sequence: Synthetic peptide
ARVLNWFD

SEQ ID NO: 4714 - protein, 7 aa, Artificial Sequence
  Description of Artificial Sequence: Synthetic peptide
SDWLAWY

SEQ ID NO: 4715 - protein, 10 aa, Artificial Sequence
  Description of Artificial Sequence: Synthetic peptide
LLIFAASSLQ

SEQ ID NO: 4716 - protein, 8 aa, Artificial Sequence
  Description of Artificial Sequence: Synthetic peptide
QQANSFPY

SEQ ID NO: 4717 - protein, 8 aa, Artificial Sequence
  Description of Artificial Sequence: Synthetic peptide
GGSFSGYY

SEQ ID NO: 4718 - protein, 7 aa, Artificial Sequence
  Description of Artificial Sequence: Synthetic peptide
INQSGNT

SEQ ID NO: 4719 - protein, 9 aa, Artificial Sequence
  Description of Artificial Sequence: Synthetic peptide
ARVLNWFDY

SEQ ID NO: 4720 - protein, 6 aa, Artificial Sequence
  Description of Artificial Sequence: Synthetic peptide
QGISDW

SEQ ID NO: 4721 - protein, 3 aa, Artificial Sequence
  Description of Artificial Sequence: Synthetic peptide
AAS

SEQ ID NO: 4722 - protein, 9 aa, Artificial Sequence
  Description of Artificial Sequence: Synthetic peptide
QQANSFPYT

SEQ ID NO: 4723 - protein, 115 aa, Artificial Sequence
  Description of Artificial Sequence: Synthetic polypeptide
QVQLQQWGAGLLKPSETLSLTCAAYGGSFSGYYWSWIRQSPGKGLEWIGEINQSGNTNYNPSLKSRVTISADTSKNQFSLKLSSVTAADTAVYYCARVLNWFDYWGQGILVTVSS

SEQ ID NO: 4724 - protein, 107 aa, Artificial Sequence
  Description of Artificial Sequence: Synthetic polypeptide
DIQMTQSPSSVSASVGDRVTITCRASQGISDWLAWYQQKSGKAPDLLIFAASSLQSGVPSRFSGSGSGTDFTLTISSLQPEDFATYYCQQANSFPYTFGQGTKLEIK

SEQ ID NO: 4725-4726 - skipped (2 entries)

SEQ ID NO: 4727 - protein, 5 aa, Artificial Sequence
  Description of Artificial Sequence: Synthetic peptide
SYSMN

SEQ ID NO: 4728 - protein, 17 aa, Artificial Sequence
  Description of Artificial Sequence: Synthetic peptide
FISSSSSYIYYADSVKG

SEQ ID NO: 4729 - protein, 15 aa, Artificial Sequence
  Description of Artificial Sequence: Synthetic peptide
ERGDDYGDYEGAFDI

SEQ ID NO: 4730 - protein, 11 aa, Artificial Sequence
  Description of Artificial Sequence: Synthetic peptide
QASQDISNYLN

SEQ ID NO: 4731 - protein, 7 aa, Artificial Sequence
  Description of Artificial Sequence: Synthetic peptide
DASNLET

SEQ ID NO: 4732 - protein, 9 aa, Artificial Sequence
  Description of Artificial Sequence: Synthetic peptide
QQYDNLPYT

SEQ ID NO: 4733 - protein, 7 aa, Artificial Sequence
  Description of Artificial Sequence: Synthetic peptide
GFTFSSY

SEQ ID NO: 4734 - protein, 6 aa, Artificial Sequence
  Description of Artificial Sequence: Synthetic peptide
SSSSSY

SEQ ID NO: 4735 - protein, 14 aa, Artificial Sequence
  Description of Artificial Sequence: Synthetic peptide
ERGDDYGDYEGAFD

SEQ ID NO: 4736 - protein, 7 aa, Artificial Sequence
  Description of Artificial Sequence: Synthetic peptide
SQDISNY

SEQ ID NO: 4737 - protein, 3 aa, Artificial Sequence
  Description of Artificial Sequence: Synthetic peptide
DAS

SEQ ID NO: 4738 - protein, 6 aa, Artificial Sequence
  Description of Artificial Sequence: Synthetic peptide
YDNLPY

SEQ ID NO: 4739 - protein, 10 aa, Artificial Sequence
  Description of Artificial Sequence: Synthetic peptide
GFTFSSYSMN

SEQ ID NO: 4740 - protein, 10 aa, Artificial Sequence
  Description of Artificial Sequence: Synthetic peptide
FISSSSSYIY

SEQ ID NO: 4741 - protein, 15 aa, Artificial Sequence
  Description of Artificial Sequence: Synthetic peptide
ERGDDYGDYEGAFDI

SEQ ID NO: 4742 - protein, 11 aa, Artificial Sequence
  Description of Artificial Sequence: Synthetic peptide
QASQDISNYLN

SEQ ID NO: 4743 - protein, 7 aa, Artificial Sequence
  Description of Artificial Sequence: Synthetic peptide
DASNLET

SEQ ID NO: 4744 - protein, 9 aa, Artificial Sequence
  Description of Artificial Sequence: Synthetic peptide
QQYDNLPYT

SEQ ID NO: 4745 - protein, 6 aa, Artificial Sequence
  Description of Artificial Sequence: Synthetic peptide
SSYSMN

SEQ ID NO: 4746 - protein, 13 aa, Artificial Sequence
  Description of Artificial Sequence: Synthetic peptide
WVSFISSSSSYIY

SEQ ID NO: 4747 - protein, 16 aa, Artificial Sequence
  Description of Artificial Sequence: Synthetic peptide
ARERGDDYGDYEGAFD

SEQ ID NO: 4748 - protein, 7 aa, Artificial Sequence
  Description of Artificial Sequence: Synthetic peptide
SNYLNWY

SEQ ID NO: 4749 - protein, 10 aa, Artificial Sequence
  Description of Artificial Sequence: Synthetic peptide
LLIYDASNLE

SEQ ID NO: 4750 - protein, 8 aa, Artificial Sequence
  Description of Artificial Sequence: Synthetic peptide
QQYDNLPY

SEQ ID NO: 4751 - protein, 8 aa, Artificial Sequence
  Description of Artificial Sequence: Synthetic peptide
GFTFSSYS

SEQ ID NO: 4752 - protein, 8 aa, Artificial Sequence
  Description of Artificial Sequence: Synthetic peptide
ISSSSSYI

SEQ ID NO: 4753 - protein, 17 aa, Artificial Sequence
  Description of Artificial Sequence: Synthetic peptide
ARERGDDYGDYEGAFDI

SEQ ID NO: 4754 - protein, 6 aa, Artificial Sequence
  Description of Artificial Sequence: Synthetic peptide
QDISNY

SEQ ID NO: 4755 - protein, 3 aa, Artificial Sequence
  Description of Artificial Sequence: Synthetic peptide
DAS

SEQ ID NO: 4756 - protein, 9 aa, Artificial Sequence
  Description of Artificial Sequence: Synthetic peptide
QQYDNLPYT

SEQ ID NO: 4757 - protein, 124 aa, Artificial Sequence
  Description of Artificial Sequence: Synthetic polypeptide
EVQLVESGGGLVKPGGSLRLSCAASGFTFSSYSMNWVRQAPGKGLEWVSFISSSSSYIYYADSVKGRFTISRDNAKNSLYLQMNSLRAEDTAVYYCARERGDDYGDYEGAFDIWGQGTMVTVSS

SEQ ID NO: 4758 - protein, 107 aa, Artificial Sequence
  Description of Artificial Sequence: Synthetic polypeptide
DIQMTQSPSSLSASVGDRVTITCQASQDISNYLNWYQQKPGKAPKLLIYDASNLETGVPSRFSGSGSGTDFTFTISSLQPEDIATYYCQQYDNLPYTFGQGTKLEIK

SEQ ID NO: 4759-4760 - skipped (2 entries)

SEQ ID NO: 4761 - protein, 5 aa, Artificial Sequence
  Description of Artificial Sequence: Synthetic peptide
NYDMH

SEQ ID NO: 4762 - protein, 16 aa, Artificial Sequence
  Description of Artificial Sequence: Synthetic peptide
TIGTAGDTYYPGSVKG

SEQ ID NO: 4763 - protein, 10 aa, Artificial Sequence
  Description of Artificial Sequence: Synthetic peptide
GGDYYYGMDV

SEQ ID NO: 4764 - protein, 12 aa, Artificial Sequence
  Description of Artificial Sequence: Synthetic peptide
RASQSVSSSYLA

SEQ ID NO: 4765 - protein, 7 aa, Artificial Sequence
  Description of Artificial Sequence: Synthetic peptide
GASSRAT

SEQ ID NO: 4766 - protein, 9 aa, Artificial Sequence
  Description of Artificial Sequence: Synthetic peptide
QQFGSSPFT

SEQ ID NO: 4767 - protein, 7 aa, Artificial Sequence
  Description of Artificial Sequence: Synthetic peptide
GFTFSNY

SEQ ID NO: 4768 - protein, 5 aa, Artificial Sequence
  Description of Artificial Sequence: Synthetic peptide
GTAGD

SEQ ID NO: 4769 - protein, 9 aa, Artificial Sequence
  Description of Artificial Sequence: Synthetic peptide
GGDYYYGMD

SEQ ID NO: 4770 - protein, 8 aa, Artificial Sequence
  Description of Artificial Sequence: Synthetic peptide
SQSVSSSY

SEQ ID NO: 4771 - protein, 3 aa, Artificial Sequence
  Description of Artificial Sequence: Synthetic peptide
GAS

SEQ ID NO: 4772 - protein, 6 aa, Artificial Sequence
  Description of Artificial Sequence: Synthetic peptide
FGSSPF

SEQ ID NO: 4773 - protein, 10 aa, Artificial Sequence
  Description of Artificial Sequence: Synthetic peptide
GFTFSNYDMH

SEQ ID NO: 4774 - protein, 9 aa, Artificial Sequence
  Description of Artificial Sequence: Synthetic peptide
TIGTAGDTY

SEQ ID NO: 4775 - protein, 10 aa, Artificial Sequence
  Description of Artificial Sequence: Synthetic peptide
GGDYYYGMDV

SEQ ID NO: 4776 - protein, 12 aa, Artificial Sequence
  Description of Artificial Sequence: Synthetic peptide
RASQSVSSSYLA

SEQ ID NO: 4777 - protein, 7 aa, Artificial Sequence
  Description of Artificial Sequence: Synthetic peptide
GASSRAT

SEQ ID NO: 4778 - protein, 9 aa, Artificial Sequence
  Description of Artificial Sequence: Synthetic peptide
QQFGSSPFT

SEQ ID NO: 4779 - protein, 6 aa, Artificial Sequence
  Description of Artificial Sequence: Synthetic peptide
SNYDMH

SEQ ID NO: 4780 - protein, 12 aa, Artificial Sequence
  Description of Artificial Sequence: Synthetic peptide
WVSTIGTAGDTY

SEQ ID NO: 4781 - protein, 11 aa, Artificial Sequence
  Description of Artificial Sequence: Synthetic peptide
ARGGDYYYGMD

SEQ ID NO: 4782 - protein, 8 aa, Artificial Sequence
  Description of Artificial Sequence: Synthetic peptide
SSSYLAWY

SEQ ID NO: 4783 - protein, 10 aa, Artificial Sequence
  Description of Artificial Sequence: Synthetic peptide
LLIYGASSRA

SEQ ID NO: 4784 - protein, 8 aa, Artificial Sequence
  Description of Artificial Sequence: Synthetic peptide
QQFGSSPF

SEQ ID NO: 4785 - protein, 8 aa, Artificial Sequence
  Description of Artificial Sequence: Synthetic peptide
GFTFSNYD

SEQ ID NO: 4786 - protein, 7 aa, Artificial Sequence
  Description of Artificial Sequence: Synthetic peptide
IGTAGDT

SEQ ID NO: 4787 - protein, 12 aa, Artificial Sequence
  Description of Artificial Sequence: Synthetic peptide
ARGGDYYYGMDV

SEQ ID NO: 4788 - protein, 7 aa, Artificial Sequence
  Description of Artificial Sequence: Synthetic peptide
QSVSSSY

SEQ ID NO: 4789 - protein, 3 aa, Artificial Sequence
  Description of Artificial Sequence: Synthetic peptide
GAS

SEQ ID NO: 4790 - protein, 9 aa, Artificial Sequence
  Description of Artificial Sequence: Synthetic peptide
QQFGSSPFT

SEQ ID NO: 4791 - protein, 118 aa, Artificial Sequence
  Description of Artificial Sequence: Synthetic polypeptide
EVQLVESGGGLVQPGGSLRLSCAASGFTFSNYDMHWVRQATGKGLEWVSTIGTAGDTYYPGSVKGRFTISRKNAKNSLYLQMISLRAGDTAVYYCARGGDYYYGMDVWGQGTTVTVSS

SEQ ID NO: 4792 - protein, 108 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQFGSSPFTFGPGTKVDIK

SEQ ID NO: 4793-4794 - skipped (2 entries)

SEQ ID NO: 4795 - protein, 5 aa, Artificial Sequence
  Description of Artificial Sequence: Synthetic peptide
SYYWS

SEQ ID NO: 4796 - protein, 16 aa, Artificial Sequence
  Description of Artificial Sequence: Synthetic peptide
RIYTSGSTNYNPSLKS

SEQ ID NO: 4797 - protein, 12 aa, Artificial Sequence
  Description of Artificial Sequence: Synthetic peptide
DREDYYYYGMDV

SEQ ID NO: 4798 - protein, 11 aa, Artificial Sequence
  Description of Artificial Sequence: Synthetic peptide
QASHDISNYLN

SEQ ID NO: 4799 - protein, 7 aa, Artificial Sequence
  Description of Artificial Sequence: Synthetic peptide
YASNLET

SEQ ID NO: 4800 - protein, 9 aa, Artificial Sequence
  Description of Artificial Sequence: Synthetic peptide
QQYDNLPLT

SEQ ID NO: 4801 - protein, 7 aa, Artificial Sequence
  Description of Artificial Sequence: Synthetic peptide
NGSISSY

SEQ ID NO: 4802 - protein, 5 aa, Artificial Sequence
  Description of Artificial Sequence: Synthetic peptide
YTSGS

SEQ ID NO: 4803 - protein, 11 aa, Artificial Sequence
  Description of Artificial Sequence: Synthetic peptide
DREDYYYYGMD

SEQ ID NO: 4804 - protein, 7 aa, Artificial Sequence
  Description of Artificial Sequence: Synthetic peptide
SHDISNY

SEQ ID NO: 4805 - protein, 3 aa, Artificial Sequence
  Description of Artificial Sequence: Synthetic peptide
YAS

SEQ ID NO: 4806 - protein, 6 aa, Artificial Sequence
  Description of Artificial Sequence: Synthetic peptide
YDNLPL

SEQ ID NO: 4807 - protein, 10 aa, Artificial Sequence
  Description of Artificial Sequence: Synthetic peptide
NGSISSYYWS

SEQ ID NO: 4808 - protein, 9 aa, Artificial Sequence
  Description of Artificial Sequence: Synthetic peptide
RIYTSGSTN

SEQ ID NO: 4809 - protein, 12 aa, Artificial Sequence
  Description of Artificial Sequence: Synthetic peptide
DREDYYYYGMDV

SEQ ID NO: 4810 - protein, 11 aa, Artificial Sequence
  Description of Artificial Sequence: Synthetic peptide
QASHDISNYLN

SEQ ID NO: 4811 - protein, 7 aa, Artificial Sequence
  Description of Artificial Sequence: Synthetic peptide
YASNLET

SEQ ID NO: 4812 - protein, 9 aa, Artificial Sequence
  Description of Artificial Sequence: Synthetic peptide
QQYDNLPLT

SEQ ID NO: 4813 - protein, 6 aa, Artificial Sequence
  Description of Artificial Sequence: Synthetic peptide
SSYYWS

SEQ ID NO: 4814 - protein, 12 aa, Artificial Sequence
  Description of Artificial Sequence: Synthetic peptide
WIGRIYTSGSTN

SEQ ID NO: 4815 - protein, 13 aa, Artificial Sequence
  Description of Artificial Sequence: Synthetic peptide
ARDREDYYYYGMD

SEQ ID NO: 4816 - protein, 7 aa, Artificial Sequence
  Description of Artificial Sequence: Synthetic peptide
SNYLNWY

SEQ ID NO: 4817 - protein, 10 aa, Artificial Sequence
  Description of Artificial Sequence: Synthetic peptide
LLLYYASNLE

SEQ ID NO: 4818 - protein, 8 aa, Artificial Sequence
  Description of Artificial Sequence: Synthetic peptide
QQYDNLPL

SEQ ID NO: 4819 - protein, 8 aa, Artificial Sequence
  Description of Artificial Sequence: Synthetic peptide
NGSISSYY

SEQ ID NO: 4820 - protein, 7 aa, Artificial Sequence
  Description of Artificial Sequence: Synthetic peptide
IYTSGST

SEQ ID NO: 4821 - protein, 14 aa, Artificial Sequence
  Description of Artificial Sequence: Synthetic peptide
ARDREDYYYYGMDV

SEQ ID NO: 4822 - protein, 6 aa, Artificial Sequence
  Description of Artificial Sequence: Synthetic peptide
HDISNY

SEQ ID NO: 4823 - protein, 3 aa, Artificial Sequence
  Description of Artificial Sequence: Synthetic peptide
YAS

SEQ ID NO: 4824 - protein, 9 aa, Artificial Sequence
  Description of Artificial Sequence: Synthetic peptide
QQYDNLPLT

SEQ ID NO: 4825 - protein, 120 aa, Artificial Sequence
  Description of Artificial Sequence: Synthetic polypeptide
QVQLQESGPGLVKPSETLSLTCTVSNGSISSYYWSWIRQSAGKGLEWIGRIYTSGSTNYNPSLKSRVTMLVDTSKNQFSLKLSSVTAADTAVYYCARDREDYYYYGMDVWGQGTTVTVSS

SEQ ID NO: 4826 - protein, 107 aa, Artificial Sequence
  Description of Artificial Sequence: Synthetic polypeptide
DIQMTQSPSSLSASVGDRVTITCQASHDISNYLNWYQQKPGKAPKLLLYYASNLETGVPSRFSGSGSGTDFTFTITSLQPEDIGTYSCQQYDNLPLTFGGGTKVEIK

SEQ ID NO: 4827-4828 - skipped (2 entries)

SEQ ID NO: 4829 - protein, 5 aa, Artificial Sequence
  Description of Artificial Sequence: Synthetic peptide
RYYWS

SEQ ID NO: 4830 - protein, 16 aa, Artificial Sequence
  Description of Artificial Sequence: Synthetic peptide
RICTSENPNYNPALKS

SEQ ID NO: 4831 - protein, 12 aa, Artificial Sequence
  Description of Artificial Sequence: Synthetic peptide
ELERLNYYGMDV

SEQ ID NO: 4832 - protein, 11 aa, Artificial Sequence
  Description of Artificial Sequence: Synthetic peptide
QASQDISNYLN

SEQ ID NO: 4833 - protein, 7 aa, Artificial Sequence
  Description of Artificial Sequence: Synthetic peptide
DASNLES

SEQ ID NO: 4834 - protein, 9 aa, Artificial Sequence
  Description of Artificial Sequence: Synthetic peptide
QQYDTLPIT

SEQ ID NO: 4835 - protein, 7 aa, Artificial Sequence
  Description of Artificial Sequence: Synthetic peptide
GGSISRY

SEQ ID NO: 4836 - protein, 5 aa, Artificial Sequence
  Description of Artificial Sequence: Synthetic peptide
CTSEN

SEQ ID NO: 4837 - protein, 11 aa, Artificial Sequence
  Description of Artificial Sequence: Synthetic peptide
ELERLNYYGMD

SEQ ID NO: 4838 - protein, 7 aa, Artificial Sequence
  Description of Artificial Sequence: Synthetic peptide
SQDISNY

SEQ ID NO: 4839 - protein, 3 aa, Artificial Sequence
  Description of Artificial Sequence: Synthetic peptide
DAS

SEQ ID NO: 4840 - protein, 6 aa, Artificial Sequence
  Description of Artificial Sequence: Synthetic peptide
YDTLPI

SEQ ID NO: 4841 - protein, 10 aa, Artificial Sequence
  Description of Artificial Sequence: Synthetic peptide
GGSISRYYWS

SEQ ID NO: 4842 - protein, 9 aa, Artificial Sequence
  Description of Artificial Sequence: Synthetic peptide
RICTSENPN

SEQ ID NO: 4843 - protein, 12 aa, Artificial Sequence
  Description of Artificial Sequence: Synthetic peptide
ELERLNYYGMDV

SEQ ID NO: 4844 - protein, 11 aa, Artificial Sequence
  Description of Artificial Sequence: Synthetic peptide
QASQDISNYLN

SEQ ID NO: 4845 - protein, 7 aa, Artificial Sequence
  Description of Artificial Sequence: Synthetic peptide
DASNLES

SEQ ID NO: 4846 - protein, 9 aa, Artificial Sequence
  Description of Artificial Sequence: Synthetic peptide
QQYDTLPIT

SEQ ID NO: 4847 - protein, 6 aa, Artificial Sequence
  Description of Artificial Sequence: Synthetic peptide
SRYYWS

SEQ ID NO: 4848 - protein, 12 aa, Artificial Sequence
  Description of Artificial Sequence: Synthetic peptide
WIGRICTSENPN

SEQ ID NO: 4849 - protein, 13 aa, Artificial Sequence
  Description of Artificial Sequence: Synthetic peptide
ARELERLNYYGMD

SEQ ID NO: 4850 - protein, 7 aa, Artificial Sequence
  Description of Artificial Sequence: Synthetic peptide
SNYLNWY

SEQ ID NO: 4851 - protein, 10 aa, Artificial Sequence
  Description of Artificial Sequence: Synthetic peptide
LLIYDASNLE

SEQ ID NO: 4852 - protein, 8 aa, Artificial Sequence
  Description of Artificial Sequence: Synthetic peptide
QQYDTLPI

SEQ ID NO: 4853 - protein, 8 aa, Artificial Sequence
  Description of Artificial Sequence: Synthetic peptide
GGSISRYY

SEQ ID NO: 4854 - protein, 7 aa, Artificial Sequence
  Description of Artificial Sequence: Synthetic peptide
ICTSENP

SEQ ID NO: 4855 - protein, 14 aa, Artificial Sequence
  Description of Artificial Sequence: Synthetic peptide
ARELERLNYYGMDV

SEQ ID NO: 4856 - protein, 6 aa, Artificial Sequence
  Description of Artificial Sequence: Synthetic peptide
QDISNY

SEQ ID NO: 4857 - protein, 3 aa, Artificial Sequence
  Description of Artificial Sequence: Synthetic peptide
DAS

SEQ ID NO: 4858 - protein, 9 aa, Artificial Sequence
  Description of Artificial Sequence: Synthetic peptide
QQYDTLPIT

SEQ ID NO: 4859 - protein, 120 aa, Artificial Sequence
  Description of Artificial Sequence: Synthetic polypeptide
QVQLQESGPGLVKPSETLSLTCTVSGGSISRYYWSWIRQPAGKGLEWIGRICTSENPNYNPALKSRVTMSVDTSKNQFSLKLSSVTAADTAVYYCARELERLNYYGMDVWGQGTTVTVSS

SEQ ID NO: 4860 - protein, 107 aa, Artificial Sequence
  Description of Artificial Sequence: Synthetic polypeptide
DIQMTQFPSSLSASVGDRVTITCQASQDISNYLNWYQQKPGKAPKLLIYDASNLESGVPSRFSGRGSGTDFTFTISSLQPEDFATFYCQQYDTLPITFGQGTRLEIK

SEQ ID NO: 4861-4862 - skipped (2 entries)

SEQ ID NO: 4863 - protein, 5 aa, Artificial Sequence
  Description of Artificial Sequence: Synthetic peptide
SYDVH

SEQ ID NO: 4864 - protein, 16 aa, Artificial Sequence
  Description of Artificial Sequence: Synthetic peptide
TIGTAGDTYYPGSVKG

SEQ ID NO: 4865 - protein, 10 aa, Artificial Sequence
  Description of Artificial Sequence: Synthetic peptide
GGFYYYGMDV

SEQ ID NO: 4866 - protein, 12 aa, Artificial Sequence
  Description of Artificial Sequence: Synthetic peptide
RASQSVSSSYLA

SEQ ID NO: 4867 - protein, 7 aa, Artificial Sequence
  Description of Artificial Sequence: Synthetic peptide
GASSRAT

SEQ ID NO: 4868 - protein, 9 aa, Artificial Sequence
  Description of Artificial Sequence: Synthetic peptide
QQSGSSPFT

SEQ ID NO: 4869 - protein, 7 aa, Artificial Sequence
  Description of Artificial Sequence: Synthetic peptide
GFTFSSY

SEQ ID NO: 4870 - protein, 5 aa, Artificial Sequence
  Description of Artificial Sequence: Synthetic peptide
GTAGD

SEQ ID NO: 4871 - protein, 9 aa, Artificial Sequence
  Description of Artificial Sequence: Synthetic peptide
GGFYYYGMD

SEQ ID NO: 4872 - protein, 8 aa, Artificial Sequence
  Description of Artificial Sequence: Synthetic peptide
SQSVSSSY

SEQ ID NO: 4873 - protein, 3 aa, Artificial Sequence
  Description of Artificial Sequence: Synthetic peptide
GAS

SEQ ID NO: 4874 - protein, 6 aa, Artificial Sequence
  Description of Artificial Sequence: Synthetic peptide
SGSSPF

SEQ ID NO: 4875 - protein, 10 aa, Artificial Sequence
  Description of Artificial Sequence: Synthetic peptide
GFTFSSYDVH

SEQ ID NO: 4876 - protein, 9 aa, Artificial Sequence
  Description of Artificial Sequence: Synthetic peptide
TIGTAGDTY

SEQ ID NO: 4877 - protein, 10 aa, Artificial Sequence
  Description of Artificial Sequence: Synthetic peptide
GGFYYYGMDV

SEQ ID NO: 4878 - protein, 12 aa, Artificial Sequence
  Description of Artificial Sequence: Synthetic peptide
RASQSVSSSYLA

SEQ ID NO: 4879 - protein, 7 aa, Artificial Sequence
  Description of Artificial Sequence: Synthetic peptide
GASSRAT

SEQ ID NO: 4880 - protein, 9 aa, Artificial Sequence
  Description of Artificial Sequence: Synthetic peptide
QQSGSSPFT

SEQ ID NO: 4881 - protein, 6 aa, Artificial Sequence
  Description of Artificial Sequence: Synthetic peptide
SSYDVH

SEQ ID NO: 4882 - protein, 12 aa, Artificial Sequence
  Description of Artificial Sequence: Synthetic peptide
WVSTIGTAGDTY

SEQ ID NO: 4883 - protein, 11 aa, Artificial Sequence
  Description of Artificial Sequence: Synthetic peptide
ARGGFYYYGMD

SEQ ID NO: 4884 - protein, 8 aa, Artificial Sequence
  Description of Artificial Sequence: Synthetic peptide
SSSYLAWY

SEQ ID NO: 4885 - protein, 10 aa, Artificial Sequence
  Description of Artificial Sequence: Synthetic peptide
LLIYGASSRA

SEQ ID NO: 4886 - protein, 8 aa, Artificial Sequence
  Description of Artificial Sequence: Synthetic peptide
QQSGSSPF

SEQ ID NO: 4887 - protein, 8 aa, Artificial Sequence
  Description of Artificial Sequence: Synthetic peptide
GFTFSSYD

SEQ ID NO: 4888 - protein, 7 aa, Artificial Sequence
  Description of Artificial Sequence: Synthetic peptide
IGTAGDT

SEQ ID NO: 4889 - protein, 12 aa, Artificial Sequence
  Description of Artificial Sequence: Synthetic peptide
ARGGFYYYGMDV

SEQ ID NO: 4890 - protein, 7 aa, Artificial Sequence
  Description of Artificial Sequence: Synthetic peptide
QSVSSSY

SEQ ID NO: 4891 - protein, 3 aa, Artificial Sequence
  Description of Artificial Sequence: Synthetic peptide
GAS

SEQ ID NO: 4892 - protein, 9 aa, Artificial Sequence
  Description of Artificial Sequence: Synthetic peptide
QQSGSSPFT

SEQ ID NO: 4893 - protein, 118 aa, Artificial Sequence
  Description of Artificial Sequence: Synthetic polypeptide
EVQLVESGGGLVQPGGSLRLSCAASGFTFSSYDVHWVRQATGKGLEWVSTIGTAGDTYYPGSVKGRFTISRENAKNSLYLQMNSLRAGDTAVYYCARGGFYYYGMDVWGQGTTVTVSS

SEQ ID NO: 4894 - protein, 108 aa, Artificial Sequence
  Description of Artificial Sequence: Synthetic polypeptide
EIVLTQSPGTLSLSPGERATLSCRASQSVSSSYLAWYQQKPGQTPRLLIYGASSRATGIPDRFSGSGSGTDFTLTISRLEPEDFAVFYCQQSGSSPFTFGPGTKVDVK

SEQ ID NO: 4895-4896 - skipped (2 entries)

SEQ ID NO: 4897 - protein, 5 aa, Artificial Sequence
  Description of Artificial Sequence: Synthetic peptide
SYYWN

SEQ ID NO: 4898 - protein, 16 aa, Artificial Sequence
  Description of Artificial Sequence: Synthetic peptide
RIYASGSTNYNPSLKS

SEQ ID NO: 4899 - protein, 10 aa, Artificial Sequence
  Description of Artificial Sequence: Synthetic peptide
DGGVGDSLDY

SEQ ID NO: 4900 - protein, 17 aa, Artificial Sequence
  Description of Artificial Sequence: Synthetic peptide
RSSQSLLDSDDGNTYLD

SEQ ID NO: 4901 - protein, 7 aa, Artificial Sequence
  Description of Artificial Sequence: Synthetic peptide
TLSYRAS

SEQ ID NO: 4902 - protein, 9 aa, Artificial Sequence
  Description of Artificial Sequence: Synthetic peptide
MQRIEFPFT

SEQ ID NO: 4903 - protein, 7 aa, Artificial Sequence
  Description of Artificial Sequence: Synthetic peptide
GDSIRSY

SEQ ID NO: 4904 - protein, 5 aa, Artificial Sequence
  Description of Artificial Sequence: Synthetic peptide
YASGS

SEQ ID NO: 4905 - protein, 9 aa, Artificial Sequence
  Description of Artificial Sequence: Synthetic peptide
DGGVGDSLD

SEQ ID NO: 4906 - protein, 13 aa, Artificial Sequence
  Description of Artificial Sequence: Synthetic peptide
SQSLLDSDDGNTY

SEQ ID NO: 4907 - protein, 3 aa, Artificial Sequence
  Description of Artificial Sequence: Synthetic peptide
TLS

SEQ ID NO: 4908 - protein, 6 aa, Artificial Sequence
  Description of Artificial Sequence: Synthetic peptide
RIEFPF

SEQ ID NO: 4909 - protein, 10 aa, Artificial Sequence
  Description of Artificial Sequence: Synthetic peptide
GDSIRSYYWN

SEQ ID NO: 4910 - protein, 9 aa, Artificial Sequence
  Description of Artificial Sequence: Synthetic peptide
RIYASGSTN

SEQ ID NO: 4911 - protein, 10 aa, Artificial Sequence
  Description of Artificial Sequence: Synthetic peptide
DGGVGDSLDY

SEQ ID NO: 4912 - protein, 17 aa, Artificial Sequence
  Description of Artificial Sequence: Synthetic peptide
RSSQSLLDSDDGNTYLD

SEQ ID NO: 4913 - protein, 7 aa, Artificial Sequence
  Description of Artificial Sequence: Synthetic peptide
TLSYRAS

SEQ ID NO: 4914 - protein, 9 aa, Artificial Sequence
  Description of Artificial Sequence: Synthetic peptide
MQRIEFPFT

SEQ ID NO: 4915 - protein, 6 aa, Artificial Sequence
  Description of Artificial Sequence: Synthetic peptide
RSYYWN

SEQ ID NO: 4916 - protein, 12 aa, Artificial Sequence
  Description of Artificial Sequence: Synthetic peptide
WIGRIYASGSTN

SEQ ID NO: 4917 - protein, 11 aa, Artificial Sequence
  Description of Artificial Sequence: Synthetic peptide
ARDGGVGDSLD

SEQ ID NO: 4918 - protein, 13 aa, Artificial Sequence
  Description of Artificial Sequence: Synthetic peptide
LDSDDGNTYLDWY

SEQ ID NO: 4919 - protein, 10 aa, Artificial Sequence
  Description of Artificial Sequence: Synthetic peptide
LLIYTLSYRA

SEQ ID NO: 4920 - protein, 8 aa, Artificial Sequence
  Description of Artificial Sequence: Synthetic peptide
MQRIEFPF

SEQ ID NO: 4921 - protein, 8 aa, Artificial Sequence
  Description of Artificial Sequence: Synthetic peptide
GDSIRSYY

SEQ ID NO: 4922 - protein, 7 aa, Artificial Sequence
  Description of Artificial Sequence: Synthetic peptide
IYASGST

SEQ ID NO: 4923 - protein, 12 aa, Artificial Sequence
  Description of Artificial Sequence: Synthetic peptide
ARDGGVGDSLDY

SEQ ID NO: 4924 - protein, 12 aa, Artificial Sequence
  Description of Artificial Sequence: Synthetic peptide
QSLLDSDDGNTY

SEQ ID NO: 4925 - protein, 3 aa, Artificial Sequence
  Description of Artificial Sequence: Synthetic peptide
TLS

SEQ ID NO: 4926 - protein, 9 aa, Artificial Sequence
  Description of Artificial Sequence: Synthetic peptide
MQRIEFPFT

SEQ ID NO: 4927 - protein, 118 aa, Artificial Sequence
  Description of Artificial Sequence: Synthetic polypeptide
QVQLQESGPGLVKSSETLSLTCTDSGDSIRSYYWNWIRQPAGKGLEWIGRIYASGSTNYNPSLKSRVIMSADTSKNRFSLKLSSVTAADTAVYYCARDGGVGDSLDYWGQGTLVTVSS

SEQ ID NO: 4928 - protein, 113 aa, Artificial Sequence
  Description of Artificial Sequence: Synthetic polypeptide
DIVMTQTPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPFTFGPGTKVDIK

SEQ ID NO: 4929-4930 - skipped (2 entries)

SEQ ID NO: 4931 - protein, 5 aa, Artificial Sequence
  Description of Artificial Sequence: Synthetic peptide
NYYWS

SEQ ID NO: 4932 - protein, 16 aa, Artificial Sequence
  Description of Artificial Sequence: Synthetic peptide
RIYSSGSTNYKSSLKS

SEQ ID NO: 4933 - protein, 12 aa, Artificial Sequence
  Description of Artificial Sequence: Synthetic peptide
EREAYLYYGLDV

SEQ ID NO: 4934 - protein, 11 aa, Artificial Sequence
  Description of Artificial Sequence: Synthetic peptide
RASQGITNYLA

SEQ ID NO: 4935 - protein, 7 aa, Artificial Sequence
  Description of Artificial Sequence: Synthetic peptide
VTSSFQS

SEQ ID NO: 4936 - protein, 9 aa, Artificial Sequence
  Description of Artificial Sequence: Synthetic peptide
LQHNNYPLT

SEQ ID NO: 4937 - protein, 7 aa, Artificial Sequence
  Description of Artificial Sequence: Synthetic peptide
GGSIINY

SEQ ID NO: 4938 - protein, 5 aa, Artificial Sequence
  Description of Artificial Sequence: Synthetic peptide
YSSGS

SEQ ID NO: 4939 - protein, 11 aa, Artificial Sequence
  Description of Artificial Sequence: Synthetic peptide
EREAYLYYGLD

SEQ ID NO: 4940 - protein, 7 aa, Artificial Sequence
  Description of Artificial Sequence: Synthetic peptide
SQGITNY

SEQ ID NO: 4941 - protein, 3 aa, Artificial Sequence
  Description of Artificial Sequence: Synthetic peptide
VTS

SEQ ID NO: 4942 - protein, 6 aa, Artificial Sequence
  Description of Artificial Sequence: Synthetic peptide
HNNYPL

SEQ ID NO: 4943 - protein, 10 aa, Artificial Sequence
  Description of Artificial Sequence: Synthetic peptide
GGSIINYYWS

SEQ ID NO: 4944 - protein, 9 aa, Artificial Sequence
  Description of Artificial Sequence: Synthetic peptide
RIYSSGSTN

SEQ ID NO: 4945 - protein, 12 aa, Artificial Sequence
  Description of Artificial Sequence: Synthetic peptide
EREAYLYYGLDV

SEQ ID NO: 4946 - protein, 11 aa, Artificial Sequence
  Description of Artificial Sequence: Synthetic peptide
RASQGITNYLA

SEQ ID NO: 4947 - protein, 7 aa, Artificial Sequence
  Description of Artificial Sequence: Synthetic peptide
VTSSFQS

SEQ ID NO: 4948 - protein, 9 aa, Artificial Sequence
  Description of Artificial Sequence: Synthetic peptide
LQHNNYPLT

SEQ ID NO: 4949 - protein, 6 aa, Artificial Sequence
  Description of Artificial Sequence: Synthetic peptide
INYYWS

SEQ ID NO: 4950 - protein, 12 aa, Artificial Sequence
  Description of Artificial Sequence: Synthetic peptide
WIGRIYSSGSTN

SEQ ID NO: 4951 - protein, 13 aa, Artificial Sequence
  Description of Artificial Sequence: Synthetic peptide
AREREAYLYYGLD

SEQ ID NO: 4952 - protein, 7 aa, Artificial Sequence
  Description of Artificial Sequence: Synthetic peptide
TNYLAWF

SEQ ID NO: 4953 - protein, 10 aa, Artificial Sequence
  Description of Artificial Sequence: Synthetic peptide
RLIYVTSSFQ

SEQ ID NO: 4954 - protein, 8 aa, Artificial Sequence
  Description of Artificial Sequence: Synthetic peptide
LQHNNYPL

SEQ ID NO: 4955 - protein, 8 aa, Artificial Sequence
  Description of Artificial Sequence: Synthetic peptide
GGSIINYY

SEQ ID NO: 4956 - protein, 7 aa, Artificial Sequence
  Description of Artificial Sequence: Synthetic peptide
IYSSGST

SEQ ID NO: 4957 - protein, 14 aa, Artificial Sequence
  Description of Artificial Sequence: Synthetic peptide
AREREAYLYYGLDV

SEQ ID NO: 4958 - protein, 6 aa, Artificial Sequence
  Description of Artificial Sequence: Synthetic peptide
QGITNY

SEQ ID NO: 4959 - protein, 3 aa, Artificial Sequence
  Description of Artificial Sequence: Synthetic peptide
VTS

SEQ ID NO: 4960 - protein, 9 aa, Artificial Sequence
  Description of Artificial Sequence: Synthetic peptide
LQHNNYPLT

SEQ ID NO: 4961 - protein, 120 aa, Artificial Sequence; identical to SEQ ID NO: 2241
  Description of Artificial Sequence: Synthetic polypeptide

SEQ ID NO: 4962 - protein, 107 aa, Artificial Sequence
  Description of Artificial Sequence: Synthetic polypeptide
DIQMTQSPSAMSASVGDRVTITCRASQGITNYLAWFQQKPGKVPKRLIYVTSSFQSGVPSRFSASGSGTEFNLTISGLQPEDFAIYYCLQHNNYPLTFGGGTKVEIK

SEQ ID NO: 4963-4964 - skipped (2 entries)

SEQ ID NO: 4965 - protein, 161 aa, Artificial Sequence
  Description of Artificial Sequence: Synthetic polypeptide
SQFRVSPLDRTWNLGETVELKCQVLLSNPTSGCSWLFQPRGAAASPTFLLYLSQNKPKAAEGLDTQRFSGKRLGDTFVLTLSDFRRENEGYYFCSALSNSIMYFSHFVPVFLPAKPTTTPAPRPPTPAPTIASQPLSLRPEACRPAAGGAVHTRGLDFACD

SEQ ID NO: 4966 - protein, 152 aa, Artificial Sequence
  Description of Artificial Sequence: Synthetic polypeptide
NSVLQQTPAYIKVQTNKMVMLSCEAKISLSNMRIYWLRQRQAPSSDSHHEFLALWDSAKGTIHGEEVEQEKIAVFRDASRFILNLTSVKPEDSGIYFCMIVGSPELTFGKGTQLSVVDFLPTTAQPTKKSTLKKRVCRLPRPETQKGPLCSP

SEQ ID NO: 4967 - protein, 412 aa, Artificial Sequence
  Description of Artificial Sequence: Synthetic polypeptide
MAWVWTLLFLMAAAQSIQASQFRVSPLDRTWNLGETVELKCQVLLSNPTSGCSWLFQPRGAAASPTFLLYLSQNKPKAAEGLDTQRFSGKRLGDTFVLTLSDFRRENEGYYFCSALSNSIMYFSHFVPVFLPAKPTTTPAPRPPTPAPTIASQPLSLRPEACRPAAGGAVHTRGLDFACDEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4968 - protein, 6 aa, Artificial Sequence
  Description of Artificial Sequence: Synthetic 6xHis tag
HHHHHH

SEQ ID NO: 4969 - protein, 8 aa, Artificial Sequence
  Description of Artificial Sequence: Synthetic peptide
DYKDDDDK

What is claimed:

1. An antibody that binds CD8 and/or CD4, wherein the antibody is:
   (A) an antibody that binds CD8, comprising:
   (1) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:31; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:32;
   (2) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:65; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:66;
   (3) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:99; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:100;
   (4) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:133; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:134;
   (5) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:167; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:168;
   (6) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:201; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:202;
   (7) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:235; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:236;
   (8) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:269; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:270;
   (9) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:303; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:304;
   (10) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:337; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:338;
   (11) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:371; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:372;
   (12) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:405; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:406;

(13) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:439; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:440;

(14) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:473; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:474;

(15) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:507; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:508;

(16) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:541; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:542;

(17) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:575; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:576;

(18) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:609; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:610;

(19) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:643; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:644;

(20) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:677; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:678;

(21) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:711; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:712;

(22) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:745; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:746;

(23) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:779; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:780;

(24) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:813; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:814;

(25) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:847; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:848;

(26) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:881; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:882;

(27) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:915; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:916;

(28) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:949; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:950;

(29) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:983; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:984;

(30) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1017; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1018;

(31) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1051; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1052;

(32) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1085; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1086;

(33) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1119; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1120;

(34) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1153; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1154;

(35) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1187; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1188;

(36) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1221; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1222;

(37) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1255; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1256;

(38) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1289; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1290;

(39) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1323; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1324;

(40) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1357; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1358;

(41) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1391; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1392;

(42) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1425; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1426;

(43) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1459; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1460;

(44) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1493; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1494;

(45) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1527; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1528;

(46) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1561; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1562;

(47) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1595; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1596;

(48) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1629; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1630;

(49) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1663; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1664;

(50) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1697; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1698;

(51) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1731; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1732;

(52) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1765; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1766;

(53) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1799; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1800;

(54) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1833; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1834;

(55) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1867; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1868;

(56) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1901; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1902;

(57) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1935; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1936;

(58) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1969; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1970;

(59) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2003; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2004;

(60) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2037; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2038;

(61) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2071; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2072;

(62) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2105; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2106;

(63) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2139; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2140; or

(64) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2173; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2174;

(B) an antibody that binds CD4, comprising:

(1) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2207; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2208;

(2) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2241; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2242;

(3) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2275; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2276;

(4) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2309; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2310;

(5) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2343; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2344;

(6) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2377; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2378;

(7) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2411; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2412;

(8) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2445; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2446;

(9) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2479; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2480;

(10) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2513; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2514;

(11) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2547; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2548;

(12) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2581; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2582;

(13) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2615; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2616;

(14) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2649; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2650;

(15) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2683; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2684;

(16) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2717; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2718;

(17) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2751; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2752;

(18) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2785; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2786;

(19) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2819; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2820;

(20) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2853; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2854;

(21) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2887; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2888;

(22) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2921; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2922;

(23) i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2955; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2956;

(24) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2989; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2990;

(25) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3023; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3024;

(26) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3057; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3058;

(27) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3091; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3092;

(28) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3125; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3126;

(29) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3159; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3160;

(30) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3193; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3194;

(31) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3227; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3228;

(32) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3261; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3262;

(33) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3295; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3296;

(34) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3329; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3330;

(35) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3363; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3364;

(36) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3397; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3398;

(37) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3431; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3432;

(38) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3465; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3466;

(39) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3499; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3500;

(40) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3533; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3534;

(41) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3567; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3568;

(42) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3601; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3602;

(43) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3635; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3636;

(44) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3669; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3670;

(45) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3703; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3704;

(46) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3737; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3738;

(47) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3771; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3772;

(48) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3805; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3806;

(49) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3839; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3840;

(50) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3873; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3874;

(51) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3907; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3908;

(52) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3941; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3942;

(53) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3975; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3976;

(54) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4009; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4010;

(55) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4043; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4044;

(56) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4077; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4078; or

(57) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4111; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4112;

(58) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4145; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4146;

(59) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4179; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4180;

(60) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4213; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4214;

(61) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4247; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4248;

(62) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4281; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4282;

(63) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4315; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4316;

(64) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4349; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4350;

(65) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4383; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4384;

(66) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4417; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4418;

(67) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4451; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4452;

(68) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4485; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4486;

(69) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4519; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4520;

(70) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4553; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4554;

(71) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4587; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4588;

(72) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4621; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4622;

(73) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4655; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4656;

(74) (i) a VH comprising a VH CDR1, a VH CDR2, and a VH CDR3 having an amino acid sequence of a VH CDR1, a VH CDR2, and a VH CDR3, respectively, of SEQ ID NO:4689; and (ii) a VL comprising a VL CDR1, a VL CDR2, and a VL CDR3 having an amino acid sequence of a VL CDR1, a VL CDR2, and a VL CDR3, respectively, of SEQ ID NO:4690;

(75) (i) a VH comprising a VH CDR1, a VH CDR2, and a VH CDR3 having an amino acid sequence of a VH CDR1, a VH CDR2, and a VH CDR3, respectively, of SEQ ID NO:4723; and (ii) a VL comprising a VL CDR1, a VL CDR2, and a VL CDR3 having an amino acid sequence of a VL CDR1, a VL CDR2, and a VL CDR3, respectively, of SEQ ID NO:4724;

(76) (i) a VH comprising a VH CDR1, a VH CDR2, and a VH CDR3 having an amino acid sequence of a VH CDR1, a VH CDR2, and a VH CDR3, respectively, of SEQ ID NO:4757; and (ii) a VL comprising a VL CDR1, a VL CDR2, and a VL CDR3 having an amino acid sequence of a VL CDR1, a VL CDR2, and a VL CDR3, respectively, of SEQ ID NO:4758;

(77) (i) a VH comprising a VH CDR1, a VH CDR2, and a VH CDR3 having an amino acid sequence of a VH CDR1, a VH CDR2, and a VH CDR3, respectively, of SEQ ID NO:4791; and (ii) a VL comprising a VL CDR1, a VL CDR2, and a VL CDR3 having an amino acid sequence of a VL CDR1, a VL CDR2, and a VL CDR3, respectively, of SEQ ID NO:4792;

(78) (i) a VH comprising a VH CDR1, a VH CDR2, and a VH CDR3 having an amino acid sequence of a VH CDR1, a VH CDR2, and a VH CDR3, respectively, of SEQ ID NO:4825; and (ii) a VL comprising a VL CDR1, a VL CDR2, and a VL CDR3 having an amino acid sequence of a VL CDR1, a VL CDR2, and a VL CDR3, respectively, of SEQ ID NO:4826;

(79) (i) a VH comprising a VH CDR1, a VH CDR2, and a VH CDR3 having an amino acid sequence of a VH CDR1, a VH CDR2, and a VH CDR3, respectively, of SEQ ID NO:4859; and (ii) a VL comprising a VL CDR1, a VL CDR2, and a VL CDR3 having an amino acid sequence of a VL CDR1, a VL CDR2, and a VL CDR3, respectively, of SEQ ID NO:4860;

(80) (i) a VH comprising a VH CDR1, a VH CDR2, and a VH CDR3 having an amino acid sequence of a VH CDR1, a VH CDR2, and a VH CDR3, respectively, of SEQ ID NO:4893; and (ii) a VL comprising a VL CDR1, a VL CDR2, and a VL CDR3 having an amino acid sequence of a VL CDR1, a VL CDR2, and a VL CDR3, respectively, of SEQ ID NO:4894;

(81) (i) a VH comprising a VH CDR1, a VH CDR2, and a VH CDR3 having an amino acid sequence of a VH CDR1, a VH CDR2, and a VH CDR3, respectively, of SEQ ID NO:4927; and (ii) a VL comprising a VL CDR1, a VL CDR2, and a VL CDR3 having an amino acid sequence of a VL CDR1, a VL CDR2, and a VL CDR3, respectively, of SEQ ID NO:4928; or

(82) (i) a VH comprising a VH CDR1, a VH CDR2, and a VH CDR3 having an amino acid sequence of a VH CDR1, a VH CDR2, and a VH CDR3, respectively, of SEQ ID NO:4961; and (ii) a VL comprising a VL CDR1, a VL CDR2, and a VL CDR3 having an amino acid sequence of a VL CDR1, a VL CDR2, and a VL CDR3, respectively, of SEQ ID NO:4962; or (C) a multispecific antibody, wherein the multispecific antibody comprises: a first binding domain that binds to CD8 and a second binding domain that binds to CD4, wherein (a) the first binding domain that binds to CD8 comprises:
  (1) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:31; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:32;
  (2) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:65; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:66;
  (3) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:99; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:100;
  (4) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:133; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:134;
  (5) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:167; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:168;
  (6) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:201; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:202;
  (7) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:235; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:236;
  (8) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:269; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:270;
  (9) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:303; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:304;
  (10) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:337; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:338;
  (11) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:371; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:372;
  (12) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:405; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:406;
  (13) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:439; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:440;
  (14) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:473; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:474;

(15) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:507; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:508;

(16) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:541; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:542;

(17) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:575; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:576;

(18) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:609; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:610;

(19) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:643; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:644;

(20) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:677; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:678;

(21) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:711; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:712;

(22) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:745; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:746;

(23) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:779; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:780;

(24) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:813; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:814;

(25) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:847; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:848;

(26) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:881; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:882;

(27) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:915; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:916;

(28) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:949; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:950;

(29) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:983; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:984;

(30) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1017; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1018;

(31) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1051; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1052;

(32) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1085; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1086;

(33) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1119; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1120;

(34) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1153; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1154;

(35) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1187; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1188;

(36) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1221; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1222;

(37) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1255; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1256;

(38) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1289; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1290;

(39) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1323; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1324;

(40) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1357; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1358;

(41) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1391; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1392;

(42) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1425; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1426;

(43) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1459; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1460;

(44) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1493; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1494;

(45) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1527; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1528;

(46) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1561; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1562;

(47) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1595; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1596;

(48) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1629; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1630;

(49) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1663; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1664;

(50) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1697; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1698;

(51) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1731; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1732;

(52) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1765; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1766;

(53) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1799; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1800;

(54) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1833; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1834;

(55) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1867; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1868;

(56) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1901; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1902;

(57) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1935; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1936;

(58) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1969; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1970;

(59) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2003; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2004;

(60) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2037; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2038;

(61) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2071; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2072;

(62) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2105; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2106;

(63) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2139; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2140; or

(64) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2173; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2174; and (b) the second binding domain that binds to CD4 comprises:

(1) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2207; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2208;

(2) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2241; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2242;

(3) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2275; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2276;

(4) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2309; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2310;

(5) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2343; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2344;

(6) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2377; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2378;

(7) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2411; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2412;

(8) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2445; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2446;

(9) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2479; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2480;

(10) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2513; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2514;

(11) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2547; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2548;

(12) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2581; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2582;

(13) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2615; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2616;

(14) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2649; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2650;

(15) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2683; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2684;

(16) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2717; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2718;

(17) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2751; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2752;

(18) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2785; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2786;

(19) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2819; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2820;

(20) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2853; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2854;

(21) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2887; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2888;

(22) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2921; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2922;

(23) i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2955; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2956;

(24) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:2989; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:2990;

(25) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3023; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3024;

(26) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3057; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3058;

(27) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3091; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3092;

(28) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3125; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3126;

(29) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3159; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3160;

(30) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3193; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3194;

(31) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3227; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3228;

(32) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3261; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3262;

(33) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3295; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3296;

(34) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3329; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3330;

(35) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3363; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3364;

(36) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3397; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3398;

(37) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3431; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3432;

(38) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3465; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3466;

(39) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3499; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3500;

(40) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3533; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3534;

(41) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3567; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3568;

(42) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3601; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3602;

(43) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3635; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3636;

(44) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3669; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3670;

(45) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3703; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3704;

(46) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3737; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3738;

(47) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3771; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3772;

(48) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3805; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3806;

(49) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3839; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3840;

(50) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3873; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3874;

(51) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3907; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3908;

(52) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3941; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3942;

(53) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:3975; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:3976;

(54) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4009; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4010;

(55) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4043; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4044;

(56) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4077; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4078; or

(57) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4111; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4112;

(58) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4145; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4146;

(59) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4179; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4180;

(60) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4213; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4214;

(61) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4247; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4248;

(62) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4281; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4282;

(63) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4315; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4316;

(64) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4349; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4350;

(65) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4383; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4384;

(66) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4417; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4418;

(67) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4451; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4452;

(68) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4485; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4486;

(69) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4519; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4520;

(70) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4553; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4554;

(71) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4587; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4588;

(72) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4621; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4622;

(73) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:4655; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:4656;

(74) (i) a VH comprising a VH CDR1, a VH CDR2, and a VH CDR3 having an amino acid sequence of a VH CDR1, a VH CDR2, and a VH CDR3, respectively, of SEQ ID NO:4689; and (ii) a VL comprising a VL CDR1, a VL CDR2, and a VL CDR3 having an amino acid sequence of a VL CDR1, a VL CDR2, and a VL CDR3, respectively, of SEQ ID NO:4690;

(75) (i) a VH comprising a VH CDR1, a VH CDR2, and a VH CDR3 having an amino acid sequence of a VH CDR1, a VH CDR2, and a VH CDR3, respectively, of SEQ ID NO:4723; and (ii) a VL comprising a VL CDR1, a VL CDR2, and a VL CDR3 having an amino acid sequence of a VL CDR1, a VL CDR2, and a VL CDR3, respectively, of SEQ ID NO:4724;

(76) (i) a VH comprising a VH CDR1, a VH CDR2, and a VH CDR3 having an amino acid sequence of a VH CDR1, a VH CDR2, and a VH CDR3, respectively, of SEQ ID NO:4757; and (ii) a VL comprising a VL CDR1, a VL CDR2, and a VL CDR3 having an amino acid sequence of a VL CDR1, a VL CDR2, and a VL CDR3, respectively, of SEQ ID NO:4758;

(77) (i) a VH comprising a VH CDR1, a VH CDR2, and a VH CDR3 having an amino acid sequence of a VH CDR1, a VH CDR2, and a VH CDR3, respectively, of SEQ ID NO:4791; and (ii) a VL comprising a VL CDR1, a VL CDR2, and a VL CDR3 having an amino acid sequence of a VL CDR1, a VL CDR2, and a VL CDR3, respectively, of SEQ ID NO:4792;

(78) (i) a VH comprising a VH CDR1, a VH CDR2, and a VH CDR3 having an amino acid sequence of a VH CDR1, a VH CDR2, and a VH CDR3, respectively, of SEQ ID NO:4825; and (ii) a VL comprising a VL CDR1, a VL CDR2, and a VL CDR3 having an amino acid sequence of a VL CDR1, a VL CDR2, and a VL CDR3, respectively, of SEQ ID NO:4826;

(79) (i) a VH comprising a VH CDR1, a VH CDR2, and a VH CDR3 having an amino acid sequence of a VH CDR1, a VH CDR2, and a VH CDR3, respectively, of SEQ ID NO:4859; and (ii) a VL comprising a VL CDR1, a VL CDR2, and a VL CDR3 having an amino acid sequence of a VL CDR1, a VL CDR2, and a VL CDR3, respectively, of SEQ ID NO:4860;

(80) (i) a VH comprising a VH CDR1, a VH CDR2, and a VH CDR3 having an amino acid sequence of a VH CDR1, a VH CDR2, and a VH CDR3, respectively, of SEQ ID NO:4893; and (ii) a VL comprising a VL CDR1, a VL CDR2, and a VL CDR3 having an amino acid sequence of a VL CDR1, a VL CDR2, and a VL CDR3, respectively, of SEQ ID NO:4894;

(81) (i) a VH comprising a VH CDR1, a VH CDR2, and a VH CDR3 having an amino acid sequence of a VH CDR1, a VH CDR2, and a VH CDR3, respectively, of SEQ ID NO:4927; and (ii) a VL comprising a VL CDR1, a VL CDR2, and a VL CDR3 having an amino acid sequence of a VL CDR1, a VL CDR2, and a VL CDR3, respectively, of SEQ ID NO:4928; or

(82) (i) a VH comprising a VH CDR1, a VH CDR2, and a VH CDR3 having an amino acid sequence of a VH CDR1, a VH CDR2, and a VH CDR3, respectively, of SEQ ID NO:4961; and (ii) a VL comprising a VL CDR1, a VL CDR2, and a VL CDR3 having an amino acid sequence of a VL CDR1, a VL CDR2, and a VL CDR3, respectively, of SEQ ID NO:4962.

2. The antibody of claim 1, wherein the VH CDR1, VH CDR2, VH CDR3, VL CDR1, VL CDR2, and VL CDR3 amino acid sequences are according to
   (i) the Kabat numbering system;
   (ii) the Chothia numbering system;
   (iii) the AbM numbering system;
   (iv) the Contact numbering system; or
   (v) the IMGT numbering system.

3. The antibody of claim 1, wherein the antibody is a humanized antibody.

4. The antibody of claim 1, wherein the antibody is an IgG antibody, and wherein optionally the IgG antibody is an IgG1, IgG2, IgG3 or IgG4 antibody.

5. The antibody of claim 1, wherein the antibody comprises (i) a kappa light chain or (ii) a lambda light chain.

6. The antibody of claim 1, wherein the antibody is a monoclonal antibody.

7. The antibody of claim 1, wherein:
(A) (i) the antibody that binds to CD8 binds a CD8 antigen or a CD8 epitope, wherein optionally the antibody specifically binds the CD8 antigen or CD8 epitope;

(ii) the antibody that binds to CD4 binds a CD4 antigen or a CD4 epitope, wherein optionally the antibody specifically binds the CD4 antigen or CD4 epitope; or (iii) the multispecific antibody that binds to CD8 and CD4 comprises a first binding domain that binds to a CD8 antigen or a CD8 epitope, and a second binding domain that binds to a CD4 antigen or a CD4 epitope;

wherein optionally
(a) the first binding domain specifically binds the CD8 antigen or CD8 epitope,
(b) the second binding domain specifically binds the CD4 antigen or CD4 epitope, or
(c) the first binding domain specifically binds the CD8 antigen or CD8 epitope, and the second binding domain specifically binds the CD4 antigen or CD4 epitope; or (B) (i) the CD8 is present on the surface of a T cell;
(ii) the CD4 is present on the surface of a T cell; or
(iii) both the CD8 and CD4 are present on the surface of a T cell.

8. The antibody of claim 1, wherein
(i) the antibody that binds to CD8
(a) binds to CD8α,
wherein optionally the antibody binds a CD8α antigen or a CD8α epitope,
wherein optionally the VH CDR1, VH CDR2, VH CDR3, VL CDR1, VL CDR2 and VL CDR3 form a binding site for an antigen of the CD8α or an epitope of the CD8a;
(b) binds to CD8β,
wherein optionally the antibody binds a CD8β antigen or a CD8β epitope,
wherein optionally the VH CDR1, VH CDR2, VH CDR3, VL CDR1, VL CDR2 and VL CDR3 form a binding site for an antigen of the CD8β or an epitope of the CD8β; or
(c) binds at the interface of CD8α and CD8β,
wherein optionally the antibody binds an antigen or an epitope at the interface of the CD8α and CD8β,
wherein optionally the VH CDR1, VH CDR2, VH CDR3, VL CDR1, VL CDR2 and VL CDR3 form a binding site for an antigen at the interface of the CD8α and CD8β or form a binding site for an epitope at the interface of the CD8α and CD8β;
(ii) the first binding domain of the multispecific antibody
(a) binds to CD8α,
wherein optionally the first binding domain binds a CD8α antigen or a CD8α epitope,
wherein optionally the VH CDR1, VH CDR2, VH CDR3, VL CDR1, VL CDR2 and VL CDR3 of the first binding domain form a binding site for an antigen of the CD8α or an epitope of the CD8α;
(b) binds to CD8β,
wherein optionally the first binding domain binds a CD8β antigen or a CD8β epitope,
wherein optionally the VH CDR1, VH CDR2, VH CDR3, VL CDR1, VL CDR2 and VL CDR3 of the first binding domain form a binding site for an antigen of the CD8β or an epitope of the CD8β; or
(c) binds at the interface of CD8α and CD8β,
wherein optionally the first binding domain binds an antigen or an epitope at the interface of the CD8α and CD8β,
wherein optionally the VH CDR1, VH CDR2, VH CDR3, VL CDR1, VL CDR2 and VL CDR3 form a binding site for an antigen at the interface of the CD8α and CD8β or form a binding site for an epitope at the interface of the CD8α and CD8β.

9. The antibody of claim 1, wherein
(i) the antibody is multivalent,
wherein optionally the antibody binds to at least three antigens, at least four antigens, or at least five antigens; or
(ii) the antibody is a multispecific antibody,
wherein optionally the multispecific antibody is a bispecific antibody, a trispecific antibody, or a quadraspecific antibody.

10. The antibody of claim 1, wherein
(A) the antibody that binds to CD8 is a multispecific CD8 antibody, wherein the multispecific CD8 antibody comprises:
(a) a first binding domain that binds CD8, and a second binding domain that binds to a second target,
wherein optionally
(i) the second target is CD4,
(ii) the second target is a T cell receptor (TCR) complex or
(iii) the second target is a T cell costimulatory molecule
(b) a first binding domain that binds CD8, a second binding domain that binds to a second target, and a third binding domain that binds to a third target,
wherein optionally
(i) the second target is CD4,
(ii) the second target is a TCR complex
(iii) the second target is a T cell costimulatory molecule
(iv) the second target is CD4, and
the third target is a TCR complex,
(v) the second target is CD4, and
the third target is a T cell costimulatory molecule or
(vi) the second target is a TCR complex and
the third target is a T cell costimulatory molecule or
(c) a first binding domain that binds CD8, and a second binding domain that binds to a second target, a third binding domain that binds to a third target, and a fourth binding domain that binds to a fourth target,
wherein optionally
(i) the second target is CD4,
(ii) the second target is a TCR complex or
(iii) the second target is a T cell costimulatory molecule
(iv) the second target is CD4, and
the third target is a TCR complex
(v) the second target is CD4,
and the third target is a T cell costimulatory molecule
(vi) the second target is a TCR complex and
the third target is a T cell costimulatory molecule or
(vii) the second target is CD4,
the third target is a TCR complex and
the fourth target is a T cell costimulatory molecule
(B) the antibody that binds to CD4 is a multispecific CD4 antibody, wherein the multispecific CD4 antibody comprises:
(a) a first binding domain that binds CD4, and a second binding domain that binds to a second target,
wherein optionally
(i) the second target is CD8,
(ii) the second target is a T cell receptor (TCR) complex or (iii) the second target is a T cell costimulatory molecule
(b) a first binding domain that binds CD4, a second binding domain that binds to a second target, and a third binding domain that binds to a third target, wherein optionally
(i) the second target is CD8,
(ii) the second target is a TCR complex
(iii) the second target is a T cell costimulatory molecule
(iv) the second target is CD8, and
the third target is a TCR complex
(v) the second target is CD8,
and the third target is a T cell costimulatory molecule
(vi) the second target is a TCR complex and
the third target is a T cell costimulatory molecule or
(c) a first binding domain that binds CD4, and a second binding domain that binds to a second target, a third binding domain that binds to a third target, and a fourth binding domain that binds to a fourth target, wherein optionally
(i) the second target is CD8,
(ii) the second target is a TCR complex or
(iii) the second target is a T cell costimulatory molecule
(iv) the second target is CD8, and
the third target is a TCR complex
(v) the second target is CD8,
and the third target is a T cell costimulatory molecule
(vi) the second target is a TCR complex and
the third target is a T cell costimulatory molecule or
(vii) the second target is CD8,
the third target is a TCR complex-and
the fourth target is a T cell costimulatory molecule-or
(C) the multispecific antibody that binds to CD8 and CD4, comprises:
(a) a first binding domain that binds CD8, and a second binding domain that binds to CD4, and a third binding domain that binds to a third target; wherein optionally
(i) the third target is a TCR complex or
(ii) the third target is a T cell costimulatory molecule or
(b) a first binding domain that binds CD8, and a second binding domain that binds to CD4, a third binding domain that binds to a third target, and a fourth binding domain that binds to a fourth target, wherein optionally
the third target is a TCR complex and
the fourth target is a T cell costimulatory molecule.

11. The antibody of claim 10, wherein
(i) the TCR complex comprises CD3, CD3ε, CD3γ, CD3δ, CD3ζ, a TCRα chain, a TCRβ chain, a TCRγ chain, or a TCRδ chain, or
(ii) the T cell costimulatory molecule comprises CD28, CTLA4, ICOS, 4-1BB, GITR, CD27, OX40, CD40L, HVEM, Galectin-9, TIM-1, LFA1, CD2, or PD1.

12. A nucleic acid sequence encoding one or more VH or VL of the antibody of claim 1.

13. A vector comprising the nucleic acid of claim 12.

14. A host cell comprising the vector of claim 13.

15. A kit comprising the vector of claim 13 and packaging for the same.

16. A kit comprising the antibody of claim 1 and packaging for the same.

17. A pharmaceutical composition comprising the antibody of claim 1, and a pharmaceutically acceptable carrier.

18. A method of producing the pharmaceutical composition of claim 17, comprising combining the antibody with a pharmaceutically acceptable carrier to obtain the pharmaceutical composition.

19. A method of activating a T cell, comprising contacting the T cell with the antibody of claim 1.

20. A method of enriching, isolating, separating, purifying, sorting, selecting, capturing or detecting a cell, wherein
(A) the cell is a CD8-expressing cell, wherein the method comprises:
(i) providing a sample comprising the CD8-expressing cell; contacting the sample with the CD8 antibody of claim 1; and enriching, isolating, separating, purifying, sorting, selecting, capturing or detecting the CD8-expressing cell bound to the CD8 antibody,
(ii) contacting a CD8-expressing cell with the CD8 antibody of claim 1; and enriching, isolating, separating, purifying, sorting, selecting, capturing or detecting the CD8-expressing cell bound to the CD8 antibody, or
(iii) contacting a CD8-expressing cell with the CD8 antibody of claim 1; and enriching, isolating, separating, purifying, sorting, selecting, capturing or detecting the CD8-expressing cell based on binding of the CD8-expressing cell to the CD8 antibody,
wherein optionally the CD8-expressing cell is a T cell, wherein optionally the T cell is CD8+ cytotoxic T lymphocyte (CTL);
(B) the cell is a CD4-expressing cell, wherein the method comprises:
(i) providing a sample comprising the CD4-expressing cell; contacting the sample with the CD4 antibody of claim 1; and enriching, isolating, separating, purifying, sorting, selecting, capturing or detecting the CD4-expressing cell bound to the CD4 antibody,
(ii) contacting a CD4-expressing cell with the CD4 antibody of claim 1; and enriching, isolating, separating, purifying, sorting, selecting, capturing or detecting the CD4-expressing cell bound to the CD4 antibody, or
(iii) contacting a CD4-expressing cell with the CD4 antibody of claim 1; and enriching, isolating, separating, purifying, sorting, selecting, capturing or detecting the CD4-expressing cell based on binding of the CD4-expressing cell to the CD4 antibody,
wherein optionally the CD4-expressing cell is a T cell, wherein optionally, the T cell is a CD4+T helper cell; or
(C) the cell is a CD4-expressing cell and/or a CD8-expressing cell, wherein the method comprises:
(i) providing a sample comprising the CD4-expressing cells and/or CD8-expressing cells; contacting the sample with the multispecific antibody that binds to CD8 and CD4 of claim 1; and enriching, isolating, separating, purifying, sorting, selecting, capturing or detecting the CD4-expressing cells and/or CD8-expressing cells bound to the multispecific antibody,
(ii) contacting CD4-expressing cells and/or CD8-expressing cells with the multispecific antibody that binds to CD8 and CD4 of claim 1; and enriching, isolating, separating, purifying, sorting, selecting, capturing or detecting the CD4-expressing cells and/or CD8-expressing cells bound to the multispecific antibody, or (iii) contacting CD4-expressing cells and/or CD8-expressing cells with the multispecific antibody that binds to CD8 and CD4 of claim 1; and enriching, isolating, separating, purifying, sorting, selecting, capturing or detecting the CD4-expressing cells and/or CD8-expressing cells based on binding of the CD4-expressing cells and/or CD8-expressing cells to the multispecific antibody, wherein optionally the CD4-expressing cells and/or CD8-expressing cells are T cells, wherein optionally the CD4-expressing cells are CD4+T helper cells, wherein optionally the CD8-expressing cells are CD8+ CTL.

21. The method of claim 20, wherein the cell is provided as a sample comprising a population of cells, wherein optionally the cells are lymphocytes, wherein optionally the lymphocytes are T cells; or wherein optionally the sample is a blood sample or a tissue sample.

\* \* \* \* \*